US010859566B2

(12) United States Patent
Flechtner et al.

(10) Patent No.: US 10,859,566 B2
(45) Date of Patent: Dec. 8, 2020

(54) TREATMENT METHODS

(71) Applicant: Genocea Biosciences, Inc., Cambridge, MA (US)

(72) Inventors: Jessica Baker Flechtner, Sudbury, MA (US); Marie Lossky-Elias, Cambridge, MA (US); Pamela M. Carroll, Boston, MA (US); Hubert Lam, Quincy, MA (US); Lisa K. McNeil, Watertown, MA (US); Wendy Jane Broom, Arlington, MA (US)

(73) Assignee: GENOCEA BIOSCIENCES, INC., Cambridge, MA (US)

( * ) Notice: Subject to any disclaimer, the term of this patent is extended or adjusted under 35 U.S.C. 154(b) by 0 days.

(21) Appl. No.: 15/927,067

(22) Filed: Mar. 20, 2018

(65) Prior Publication Data

US 2019/0072543 A1 Mar. 7, 2019

Related U.S. Application Data

(60) Provisional application No. 62/583,233, filed on Nov. 8, 2017, provisional application No. 62/484,258, filed on Apr. 11, 2017, provisional application No. 62/473,899, filed on Mar. 20, 2017.

(51) Int. Cl.

| | | |
|---|---|---|
| *C12Q 1/00* | (2006.01) | |
| *G01N 33/50* | (2006.01) | |
| *C07K 16/28* | (2006.01) | |
| *C12Q 1/6886* | (2018.01) | |
| *A61P 35/00* | (2006.01) | |
| *A61K 39/00* | (2006.01) | |
| *G16H 50/30* | (2018.01) | |
| *G16H 50/20* | (2018.01) | |
| *G01N 33/574* | (2006.01) | |
| *C40B 30/04* | (2006.01) | |
| *C40B 30/06* | (2006.01) | |
| *C40B 40/10* | (2006.01) | |

(52) U.S. Cl.
CPC .... *G01N 33/5032* (2013.01); *A61K 39/00117* (2018.08); *A61K 39/001186* (2018.08); *A61P 35/00* (2018.01); *C07K 16/2818* (2013.01); *C12Q 1/6886* (2013.01); *G01N 33/505* (2013.01); *G01N 33/5011* (2013.01); *G01N 33/5023* (2013.01); *G01N 33/5044* (2013.01); *G01N 33/57484* (2013.01); *G16H 50/20* (2018.01); *G16H 50/30* (2018.01); *A61K 2039/505* (2013.01); *C07K 2317/24* (2013.01); *C12Q 2600/106* (2013.01); *C12Q 2600/136* (2013.01); *C12Q 2600/158* (2013.01); *C40B 30/04* (2013.01); *C40B 30/06* (2013.01); *C40B 40/10* (2013.01); *G01N 2800/52* (2013.01)

(58) Field of Classification Search
CPC .................................................. G01N 33/5032
See application file for complete search history.

(56) References Cited

U.S. PATENT DOCUMENTS

| | | |
|---|---|---|
| 4,863,874 A | 9/1989 | Wassef et al. |
| 4,921,757 A | 5/1990 | Wheatley et al. |
| 4,925,661 A | 5/1990 | Huang |
| 5,199,942 A | 4/1993 | Gillis |
| 5,225,212 A | 7/1993 | Martin et al. |
| 5,510,240 A | 4/1996 | Lam et al. |
| 5,643,599 A | 7/1997 | Lee et al. |
| 5,989,565 A | 11/1999 | Storkus et al. |
| 6,004,815 A | 12/1999 | Portnoy et al. |
| 6,086,898 A | 7/2000 | DeKruyff et al. |
| 6,407,063 B1 | 6/2002 | Luiten et al. |
| 7,262,269 B2 | 8/2007 | Lam et al. |
| 8,313,894 B2 | 11/2012 | Flechtner et al. |
| 9,045,791 B2 | 6/2015 | Flechtner et al. |
| 9,115,402 B2 | 8/2015 | Hacohen et al. |
| 9,873,870 B2 | 1/2018 | Flechtner et al. |
| 2002/0018785 A1 | 2/2002 | Zauderer |
| 2002/0198162 A1 | 12/2002 | Punnonen et al. |
| 2003/0003485 A1 | 1/2003 | Uenaka et al. |
| 2003/0077263 A1 | 4/2003 | Maraskovsky et al. |
| 2004/0001849 A1 | 1/2004 | Punnonen et al. |
| 2004/0115221 A1 | 6/2004 | Portnoy et al. |
| 2005/0106641 A1 | 5/2005 | Kauvar et al. |
| 2005/0112576 A1 | 5/2005 | Deml |
| 2007/0238182 A1 | 10/2007 | Gaiger et al. |
| 2008/0131871 A1 | 6/2008 | Chen et al. |
| 2010/0260791 A1 | 10/2010 | Higgins et al. |
| 2013/0102496 A1 | 4/2013 | Flechtner et al. |
| 2014/0329889 A1 | 11/2014 | Vance et al. |
| 2016/0083717 A1 | 3/2016 | Flechtner et al. |
| 2016/0362441 A1 | 12/2016 | Vernejoul et al. |

(Continued)

FOREIGN PATENT DOCUMENTS

| | | |
|---|---|---|
| EP | 1715346 A1 | 10/2006 |
| WO | WO-2006/138449 A2 | 12/2006 |
| WO | WO-2007/098255 A2 | 8/2007 |

(Continued)

OTHER PUBLICATIONS

Adler, M. J. and Dimitrov, D. S., Therapeutic antibodies against cancer, Hematol. Oncol. Clin. North Am., 26(3): 447-81 (2012).
Ayada, K. et al, Chronic Infections and Atherosclerosis, Annals of the New York Academy of Sciences, 1108:594-602 (2007).
Bach, J., Infections and Autoimmune Diseases, Journal of Autoimmunity, 25:74-80 (2005).
Barzilai, O. et al., Viral Infection Can Induce the Production of Autoantibodies, Current Opinion in Rheumatology, 19:636-643 (2007).

(Continued)

*Primary Examiner* — Albert M Navarro
(74) *Attorney, Agent, or Firm* — Choate, Hall & Stewart LLP; Brenda Herschbach Jarrell; Rolando Medina

(57) ABSTRACT

Methods and compositions for identifying tumor antigens of human lymphocytes, and for identifying subjects for cancer therapy, are provided herein.

26 Claims, 35 Drawing Sheets

Specification includes a Sequence Listing.

(56) References Cited

U.S. PATENT DOCUMENTS

2018/0362966 A1 12/2018 Flechtner et al.

FOREIGN PATENT DOCUMENTS

| WO | WO-2010/002993 A1 | 1/2010 |
|----|-------------------|--------|
| WO | WO-2014/189805 A1 | 11/2014 |
| WO | WO-2016/081947 A2 | 5/2016 |
| WO | WO-2018/175505 A1 | 9/2018 |

OTHER PUBLICATIONS

Bendtsen, J.D. et al, Improved Prediction of Signal Peptides: SignalP 3.0, Journal of Molecular Biology, 340:783-795 (2004).
Betzner, A.S. and Keck, W., Molecular Cloning, Overexpression and Mapping of the SLT Gene Encoding the Soluble Lytic Transglycosylase of *Escherichia coli*, Molecular Genetics & Genomics, 219:489-491 (1989).
Blommel, P.G. et al., High Efficiency Single Step Production of Expression Plasmids from cDNA Clones Using the Flexi Vector Cloning System, Protein Expression & Purification, 47:562-570 (2006).
Buist, G. et al., Autolysis of Lactococcus Lactis by Induced Overproduction of Its Major Autolysin, AcmA, Appled and Environmental Microbiology, 63(7):2722-2728 (1997).
Cao, P. et al., Extracellular Release of Antigenic Proteins by Helicobacter Pylori, Infection and Immunity, 66(6):2984-2986 (1998).
Chang, C. et al., S Gene Expression and the Timing of Lysis by Bacteriophage λ, Journal of Bacteriology, 177(11):3283-3294 (1995).
Choi, B.D. et al, Bispecific antibodies engage T cells for antitumor immunotherapy, Expert Opin. Biol. Ther., 11(7) 843-53 (2011).
Church, G. M., Genomes for all, Sci. Am., 294(1): 46-54 (2006).
Cobbold, M. et al, MHC class I-associated phosphopeptides are the targets of memory-like immunity in leukemia, Sci. Transl. Med., 5(203): 203ra125 (2013).
Coulie, P.G. et al, Tumour antigens recognized by T lymphocytes: at the core of cancer immunotherapy, Nat. Rev. Cancer, 14(2): 135-146 (2014).
Courvalin, P. et al., Gene Transfer from Bacteria to Mammalian Cells, Comptes Rendus de l'Académie des Sciences, 318:1207-1212 (1995).
De Magalhães, J. P. et al, Next-generation sequencing in aging research: emerging applications, problems, pitfalls and possible solutions, Ageing Res. Rev., 9(3): 315-323 (2010).
Dhabhar, F.S., Effects of stress on immune function: the good, the bad, and the beautiful, Immunol Res., 58:193-210 (2014).
Doyle, H. A. et al, Isoaspartyl post-translational modification triggers anti-tumor T and B lymphocyte immunity, J. Biol. Chem., 281(43): 32676-83 (2006).
Drouin, E.E. et al., Human Homologues of a Borrelia T Cell Epitope Associated with Antibiotic-Refractory Lyme Arthritis, Molecular Immunology, 45(1):180-189 (2008).
Falk, K. et al, Allele-Specific Motifs Revealed by Sequencing of Self-Peptides Eluted from MHC Molecules, Nature, 351(6324):290-296 (1991).
Fu, J. et al, STING agonist formulated cancer vaccines can cure established tumors resistant to PD-1 blockade, Sci. Transl. Med., 7(283): 283ra52 (2015).
Fukuhara, H. et al, Oncolytic virus therapy: A new era of cancer treatment at dawn, Cancer Sci., 107(10): 1373-1379 (2016).
Gevaert, K. and Vandekerckhove, J., Protein identification methods in proteomics, Electrophoresis, 21(6): 1145-1154 (2000).
Ghamsari et al. Genome-Scale Neoantigen Screening Using Atlas Prioritizes Candidate Antigens for Immunotherapy in a Non-Small Cell Lung Cancer Patient. In: Society of Immunotherapy of Cancer's Annual Meeting & Associated Programs, National Harbor, Nov. 9-13, 2016. Poster 374.
Gilchuk, P. et al, Discovering protective CD8 T cell epitopes—no single immunologic property predicts it!, Curr. Opin. Immunol . . . 34: 43-51 (2015).

Goodall, J.C. et al, Identification of Chlamydia Trachomatis Antigens Recognized by Human CD4+T Lymphocytes by Screening an Expression Library, European Journal of Immunology, 31:1513-1522 (2001).
Gubin, M.M. et al, Tumor neoantigens: building a framework for personalized cancer immunotherapy, J. Clin. Invest., 125(9): 3413-21 (2015).
Guthals, A. et al, Shotgun protein sequencing with meta-contig assembly, Mol. Cell Proteomics, 11(10): 1084-96 (2012).
Hadrup, S. R. et al, Parallel detection of antigen-specific T-cell responses by multidimensional encoding of MHC multimers, Nat. Methods, 6(7): 520-6 (2009).
Hall, N., Advanced sequencing technologies and their wider impact in microbiology, J. Exp. Biol., 210(Pt 9): 1518-25 (2007).
Heemskerk, B. et al, The cancer antigenome, EMBO J., 32(2): 194-203 (2013).
Heyman, B. and Yang, Y., Mechanisms of heparanase inhibitors in cancer therapy, Experimental Hematology, 44: 1002-1012 (2016).
Higgins, D.E. et al, Delivery of Protein to the Cytosol of Macrophages using *Escherichia coli* K-12, Molecular Microbiology, 31(6):1631-1641 (1999).
Hombrink, P. et al, High-throughput identification of potential minor histocompatibility antigens by MHC tetramer-based screening: feasibility and limitations, PLoS One, 6(8): e22523 (2011).
Howie, B. et al, High-throughput pairing of T cell receptor α and β sequences, Science Translational Medicine, 7(301): 301ra131 (2015).
Hu, P. H. et al., *Escherichia coli* expressing recombinant antigen and listeriolysin O stimulate class I-restricted CD8+ T cells following uptake by human APC, J. Immunol., 172(3): 1595-1601 (2004).
Huehls, A. M. et al, Bispecific T-cell engagers for cancer immunotherapy, Immunol. Cell Biol., 93(3): 290-6 (2015).
Huen, A. O. and Rook, A. H., Toll receptor agonist therapy of skin cancer and cutaneous T-cell lymphoma, Curr. Opin. Oncol., 26(2): 237-44 (2016).
Inaba, K. et al, Isolation of Dendritic Cells, Current Protocols in Immunology, 3(3.7):1-15 (1998).
International Search Report for PCT/US18/23442 (Treatment Methods, filed Mar. 20, 2018), issued by ISA/US, 5 pages (dated Aug. 8, 2018).
International Search Report for PCT/US2009/049406, 3 pages (dated Oct. 13, 2009).
Isberg, R.R. et al, Identification of Invasin: A Protein that Allows Enteric Bacteria to Penetrate Cultured Mammalian Cells, Cell, 50:769-778 (1987).
Jensen, R.B. and Gerdes, K., Programmed Cell Death in Bacteria: Proteic Plasmid Stabilization Systems, Molecular Microbiology, 17(2):205-210 (1995).
Kaczanowska, S. et al, TLR agonists: our best frenemy in cancer immunotherapy, J. Leukoc Biol., 93(6): 847-63 (2013).
Kawashima, I. et al, Identification of HLA-A3-restricted cytotoxic T lymphocyte epitopes from carcinoembryonic antigen and HER-2/neu by primary in vitro immunization with peptide-pulsed dendritic cells, Cancer Res., 59(2): 431-5 (1999).
Lam, K.S. et al, A New Type of Synthetic Peptide Library for Identifying Ligand-Binding Activity, Nature, 354:82-84 (1991).
Le, D.T. et al., PD-1 Blockade in Tumors with Mismatch-Repair Deficiency, N Engl J Med., 372:2509-2520 (2015).
Li, G. N. et al, Monoclonal antibody-related drugs for cancer therapy, Drug Discov. Ther., 7(5): 178-84 (2013).
Li, Y., Characterization and optimization of antigen-specific T cell responses during ex vivo expansion of melanoma tumor infiltrating lymphocytes, UT GSBS Dissertations and Theses (Open Access), 207 pages (2010).
Liolios, K. et al., The Genomes on Line Database (GOLD) v.2: A Monitor of Genome Projects Worldwide, Nucleic Acids Research (Database Issue), 34:D332-D334 (2006).
Lubitz, W. et al., Requirement for a Functional Host Cell Autolytic Enzyme System for Lysis of *Escherichia coli* by Bacteriophage φX174, Journal of Bacteriology, 159(1):385-387 (1984).
Magnuson, R. et al., Autoregulation of the Plasmid Addiction Operon of Bacteriophage P1*, The Journal of Biological Chemistry, 21(31):18705-18710 (1996).

(56) References Cited

OTHER PUBLICATIONS

Margot, P. et al., The LytE Gene of Bacillus Subtilis 168 Encodes a Cell Wall Hydrolase, Journal of Bacteriology, 180(3):749-752 (1998).
Marsischky, G. and Labaer, J., Many Paths to Many Clones: A Comparative Look at High-Throughput Cloning Methods, Genome Research, 14:2020-2028 (2004).
McGranahan, N. et al, Clonal neoantigens elicit T cell immunoreactivity and sensitivity to immune checkpoint blockade, Science, 351(6280): 1463-9 (2016).
Ohminami, H. et al, HLA class I-restricted lysis of leukemia cells by a CD8(+) cytotoxic T-lymphocyte clone specific for WT1 peptide, Blood, 95(1): 286-93 (2000).
Qu, H. et al., Smad4 suppresses the tumorigenesis and aggressiveness of neuroblastoma through repressing the expression of heparanase, Scientific Reports, 6(32628): 1-14 (2016).
Raab, R. et al., Dominance in Lambda S Mutations and Evidence for Translational Control, Journal of Molecular Biology, 199:95-105 (1988).
Rizvi, N.A. et al, Cancer immunology. Mutational landscape determines sensitivity to PD-1 blockade in non-small cell lung cancer, Science, 348(6230): 124-8 (2015).
Romero, A. et al., Lytic Action of Cloned Pneumococcal Phase Lysis Genes in *Streptococcus pneumoniae*, FEMS Microbiology Letters, 108:87-92 (1993).
Sanderson, S. et al., Identification of a CD4+ T Cell-Stimulating Antigen of Pathogenic Bacteria by Expression Cloning, Journal of Experimental Medicine, 182(6):1751-1757 (1995).
Scanlan, M. J. et al, Cancer/testis antigens: an expanding family of targets for cancer immunotherapy, Immunol. Rev., 188: 22-32 (2002).
Schumacher, T. N. and Schreiber, R. D., Neoantigens in cancer immunotherapy, Science, 348(6230): 69-74 (2015).
Scott, A.M. et al, Monoclonal antibodies in cancer therapy, Cancer Immun., 12:14 (2012).
Seymour, L. et al, iRECIST: guidelines for response criteria for use in trials testing immunotherapeutics, Lancet Oncol., 18(3): e143-e152 (2017).
Sharpe, M. and Mount, N., Genetically modified T cells in cancer therapy: opportunities and challenges, Dis Model Mech., 8(4): 337-50 (2015).
Simpson, A. J. et al, Cancer/testis antigens, gametogenesis and cancer, Nat. Rev. Cancer, 5(8): 615-25 (2005).
Sizemore, D.R. et al., Attenuated Shigella as a DNA Delivery Vehicle for DNA-Mediated Immunization, Science, 270:299-302 (1995).
Sliwkowski, M.X. and Mellman, I., Antibody therapeutics in cancer, Science, 341(6151): 1192-8 (2013).
Smith, A.S.G. and Rawlings, D.E., The Poison-Antidote Stability System of the Broad-Host-Rage Thiobacillus Ferrooxidans Plasmid pTF-FC2, Molecular Microbiology, 26(5)961-970 (1997).
Snyder, A. et al., Genetic Basis for Clinical Response to CTLA-4 Blockade in Melanoma, N Engl J Med., 371:2189-2199 (2014).

Tang, X-D. et al., In vitro and ex vivo evaluation of a multi-epitope heparinase vaccine for various malignancies, Cancer Sci., 105(1): 9-17 (2014).
Ten Bosch, J.R. and Grody, W. W., Keeping up with the next generation: massively parallel sequencing in clinical diagnostics, J. Mol. Diagn., 10(6): 484-92 (2008).
Therasse, P. et al, New guidelines to evaluate the response to treatment in solid tumors. European Organization for Research and Treatment of Cancer, National Cancer Institute of the United States, National Cancer Institute of Canada, J. Natl., Cancer Inst., 92(3): 205-16 (2000).
Tomasz, A. et al., Insertional Inactivation of the Major Autolysin Gene of *Streptococcus pneumoniae*, Journal of Bacteriology, 170(12):5931-5934 (1988).
Tucker, T. et al, Massively parallel sequencing: the next big thing in genetic medicine, Am. J. Hum. Genet., 85(2): 142-54 (2009).
Van Allen, E.M. et al., Genomic correlates of response to CTLA-4 blockade in metastatic melanoma, Science, 350(6257):207-211 (2015).
Van Rooij, N. et al, Tumor exome analysis reveals neoantigen-specific T-cell reactivity in an ipilimumab-responsive melanoma, J. Clin. Oncol., 31(32): e439-42 (2013).
Walhout, A.J.M. et al., Gateway Recombinational Cloning: Application to the Cloning of Large Numbers of Open Reading Frames or ORFeomes, Methods in Enzymology, 328:575-592 (2000).
Ward, J.P. et al, The Role of Neoantigens in Naturally Occurring and Therapeutically Induced Immune Responses to Cancer, Adv. Immunol., 130: 25-74 (2016).
Wittig, B. et al, MGN1703, an immunomodulator and toll-like receptor 9 (TLR-9) agonist: from bench to bedside, Crit. Rev. Oncol. Hematol., 94(1): 31-44 (2015).
Written Opinion for PCT/US18/23442 (Treatment Methods, filed Mar. 20, 2018), issued by ISA/US, 19 pages (dated Aug. 8, 2018).
Written Opinion for PCT/US2009/049406, 7 pages (dated Oct. 13, 2009).
Yamanaka, K. et al., Characterization of Bacillus Subtilis Mutants Resistant to Cold Shock-Induced Autolysis. FEMS Microbiology Letters, 150(2):269-275 (1997).
Yarchoan, M. et al, Targeting neoantigens to augment antitumour immunity, Nat. Rev. Cancer, 17(4): 209-222 (2017).
Precopio, M. L., Immunization with vaccinia virus induces polyfunctional and phenotypically distinctive CD8+ T cell responses, The Journal of Experimental Medicine, 204(6):1405-1416 (2007).
Rodo, M. J., A comparison of antigen-specific T cell responses induced by six novel tuberculosis vaccine candidates, PLoS Pathogens, 15(3):e1007643 (2018).
Ghamsari, L., et al., Genome-Scale Neoantigen Screening Using Atlas Prioritizes Candidate Antigen for Immunotherapy in a Non-Small Cell Lung Cancer Patient, poster 374 presented at SITC Annual Meeting in National Harbor, Maryland (Nov. 12, 2016).
Genocea's Proprietary ATLAS Technology Identifies Unique Candidate Antigens for Potential Personalized Cancer Vaccines, Press release presented at SITC Annual Meeting in National Harbor, Maryland (Nov. 12, 2016).
Fletchtner, J. B., Prioritization of Neoantigens without Predictions: Comprehensive T cell Screening using ATLAS, presented at Neoantigen Summit in Boston, Massachusetts (Nov. 15, 2016).

Figure 1. Multiple TAAs are recognized by T cells from a representative melanoma patient who received immune checkpoint blockade therapy.

Figure 2. CD4$^+$ T cell responses predict response to immune checkpoint blockade.

Figure 3. IFN-γ-secreting CD8$^+$ T cells predict response to immune checkpoint blockade.

Figure 4. Good alignment between replicate measurements for each cytokine.

Figure 5. Multiple suppressive or inhibitory neoantigens identified through CD8+ T cell responses pre- and post-checkpoint blockade therapy.

Figure 6. Increased breadth of CD4$^+$ T cell IFN-$\gamma$ responses to neoantigens post-checkpoint blockade therapy.

Figure 7. Limited overlap between CD8[+]-specific T cell neoantigens identified by methods of the disclosure (ATLAS) and epitope prediction algorithms.

Figure 8. Epitope prediction algorithms had a high false positive rate, missed relevant antigens, and failed to identify suppressive and/or inhibitory antigens.

Figure 9. CD8+ T cell responses of a representative colorectal cancer patient to library of TAAs.

Figure 10. CD4+ and CD8+ T cell responses of a cohort of colorectal cancer patients.

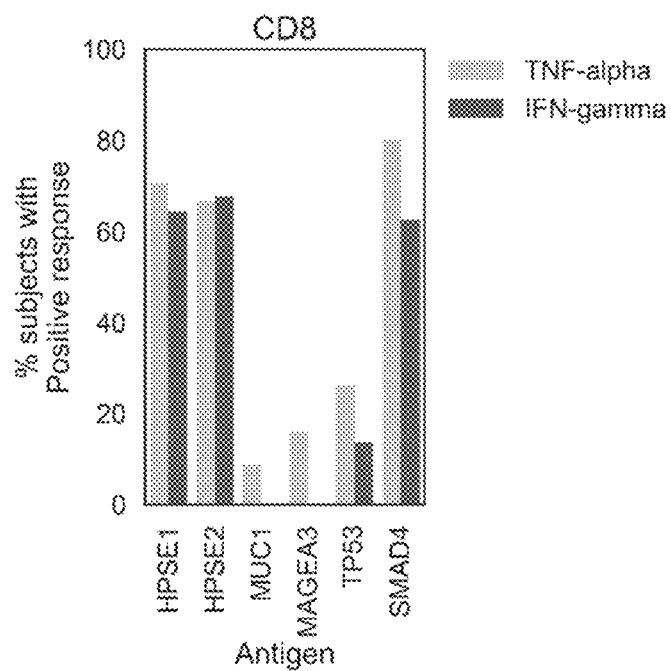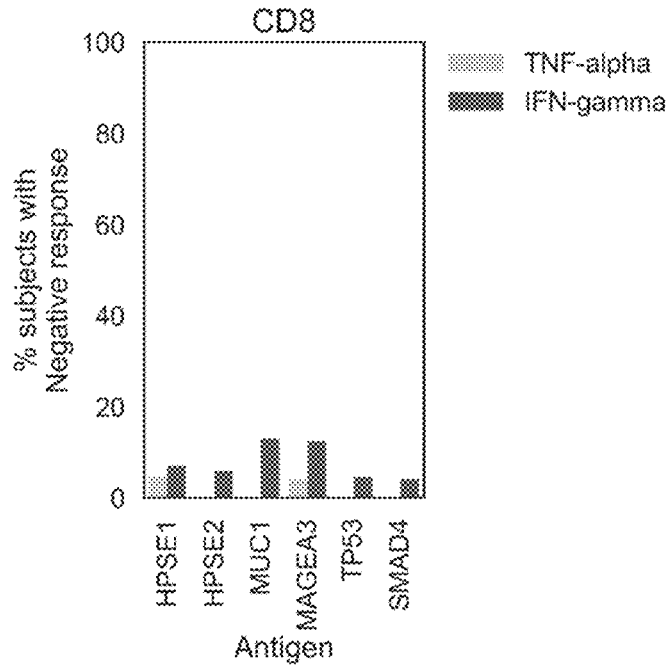
Figure 15B

TREATMENT METHODS

CROSS REFERENCE TO RELATED APPLICATIONS

This application claims the benefit of U.S. Provisional Application No. 62/583,233, filed Nov. 8, 2017, U.S. Provisional Application No. 62/484,258, filed Apr. 11, 2017 and U.S. Provisional Application No. 62/473,899, filed Mar. 20, 2017, the contents of each of which are hereby incorporated by reference herein in their entirety.

SEQUENCE LISTING

The instant application contains a Sequence Listing which has been submitted electronically in ASCII format and is hereby incorporated by reference in its entirety. Said ASCII copy, created on Apr. 16, 2018, is named 2007781-0187_SL.txt and is 2,102,834 bytes in size.

BACKGROUND

Cancer is characterized by proliferation of abnormal cells. Many treatments include costly and painful surgeries and chemotherapies. Although there is a growing interest in cancer therapies that target cancerous cells using a patient's own immune system, such therapies have had limited success.

SUMMARY

The present invention features, inter alia, methods of identifying tumor antigens and potential tumor antigens of human lymphocytes, methods of selecting tumor antigens and potential tumor antigens, as well as compositions including the tumor antigens and potential tumor antigens, methods of making such compositions, and methods of using the tumor antigens and potential tumor antigens. The invention also features methods of evaluating an immune response in a cancer subject, e.g., for identifying and/or selecting a cancer subject for initiation, continuation, modification, and/or discontinuation of a cancer therapy Accordingly, in one aspect the disclosure features a method of obtaining or generating a subject response profile. In some embodiments, the method comprises: a) obtaining, providing, or generating a library comprising bacterial cells or beads comprising a plurality of tumor antigens, wherein each bacterial cell or bead of the library comprises a different tumor antigen; b) contacting the bacterial cells or beads of the library with antigen presenting cells (APCs) from a subject, wherein the APCs internalize the bacterial cells or beads; c) contacting the APCs with lymphocytes from the subject, under conditions suitable for activation of lymphocytes by a tumor antigen presented by one or more APCs; d) determining whether one or more lymphocytes are activated by, or not responsive to, one or more tumor antigens presented by one or more APCs, e.g., by assessing (e.g., detecting or measuring) a level (e.g., an increased or decreased level, relative to a control) of expression and/or secretion of one or more immune mediators; and e) identifying one or more tumor antigens that stimulate, inhibit and/or suppress, and/or have minimal effect on a level of expression and/or secretion of one or more immune mediators, to obtain or generate a subject response profile.

In some embodiments, the subject response profile comprises a representation of the level of expression and/or secretion of the one or more immune mediators associated with the plurality of tumor antigens.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of obtaining or generating a target response profile. In some embodiments, the method comprises: a) obtaining, providing, or generating a library comprising bacterial cells or beads comprising a plurality of tumor antigens, wherein each bacterial cell or bead of the library comprises a different tumor antigen; b) contacting the bacterial cells or beads of the library with antigen presenting cells (APCs) from a subject who exhibits or previously exhibited a response to cancer, wherein the APCs internalize the bacterial cells or beads; c) contacting the APCs with lymphocytes from the subject, under conditions suitable for activation of lymphocytes by a tumor antigen presented by one or more APCs; d) determining whether one or more lymphocytes are activated by, or not responsive to, one or more tumor antigens presented by one or more APCs, e.g., by assessing (e.g., detecting or measuring) a level (e.g., an increased or decreased level, relative to a control) of expression and/or secretion of one or more immune mediators; and e) identifying one or more tumor antigens that stimulate, inhibit and/or suppress, and/or have a minimal effect on a level of expression and/or secretion of one or more immune mediators, to obtain or generate a target response profile.

In some embodiments, the subject exhibits or previously exhibited at least one beneficial response to cancer. In some embodiments, the beneficial response comprises a positive clinical response, e.g., one or more positive clinical endpoints, to a cancer therapy or combination of therapies. In some embodiments, the beneficial response comprises a spontaneous response to a cancer. In some embodiments, the beneficial response comprises clearance of a cancer, e.g., a level of one or more clinical measures associated with clearance of a cancer. In some embodiments, the beneficial response comprises a lack of a relapse, recurrence, and/or metastasis of a cancer, e.g., over a defined period of time (e.g., at least 1, 2, 3, 4, 5, 6, 7, 8, 9, 10, 11, 12 weeks, or at least 1, 2, 3, 4, 5, 6, 7, 8, 9, 10, 11, 12 months, or at least 1, 2, 3, 4, 5, 6, 7, 8, 9, 10, 11, 12 years). In some embodiments, the beneficial response comprises a positive cancer prognosis. In some embodiments, the beneficial response comprises a lack of measurable toxic responses or side effects to a cancer therapy or combination of therapies.

In some embodiments, the subject exhibits or previously exhibited at least one deleterious or non-beneficial response to cancer. In some embodiments, the deleterious response comprises a negative clinical response and/or a failure to respond, to a cancer therapy or combination of therapies. In some embodiments, the deleterious response comprises a lack of clearance of a cancer, e.g., a level of one or more clinical measures associated with lack of clearance of a cancer. In some embodiments, the deleterious response comprises at least one relapse, recurrence, and/or metastasis of a cancer. In some embodiments, the deleterious response comprises a negative cancer prognosis. In some embodiments, the deleterious response comprises one or more toxic responses or side effects (e.g., one or more measurable toxic responses or side effects) to a cancer therapy or combination of therapies.

In some embodiments, the library used to obtain the target response profile is the same library used to obtain a subject response profile.

In some embodiments, the method further comprises the step of repeating steps a) through e) with antigen presenting cells (APCs) and/or lymphocytes from additional subjects, to obtain a population-based or composite target response profile.

In some embodiments, the target response profile comprises a representation of the level of expression and/or secretion of the one or more immune mediators associated with the plurality of tumor antigens.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of identifying a subject as a candidate for cancer therapy. In some embodiments, the method comprises: a) obtaining, providing, or generating a library comprising bacterial cells or beads comprising a plurality of tumor antigens, wherein each bacterial cell or bead of the library comprises a different tumor antigen; b) contacting the bacterial cells or beads with antigen presenting cells (APCs) from the subject, wherein the APCs internalize the bacterial cells or beads; c) contacting the APCs with lymphocytes from the subject, under conditions suitable for activation of lymphocytes by a tumor antigen presented by one or more APCs; d) determining whether one or more lymphocytes are activated by, or not responsive to, one or more tumor antigens presented by one or more APCs, e.g., by assessing (e.g., detecting or measuring) a level (e.g., an increased or decreased level, relative to a control), of expression and/or secretion of one or more immune mediators; e) identifying one or more tumor antigens that stimulate, inhibit and/or suppress, and/or have a minimal effect on a level of expression and/or secretion of one or more immune mediators, to obtain or generate a subject response profile; and f) comparing the subject response profile to a target response profile to select the subject as a candidate subject for initiation, continuation, modification, discontinuation or non-initiation of a cancer therapy. In some embodiments, the subject response profile comprises a representation of the level of expression and/or secretion of the one or more immune mediators associated with the plurality of tumor antigens.

In some embodiments, the method further comprises generating the target response profile by a method comprising: g) contacting the bacterial cells or beads with antigen presenting cells (APCs) from a target subject, wherein the APCs internalize the bacterial cells or beads; h) contacting the APCs with lymphocytes from the target subject, under conditions suitable for activation of lymphocytes by a tumor antigen presented by one or more APCs; i) determining whether one or more lymphocytes are activated by, or not responsive to, one or more tumor antigens presented by one or more APCs, e.g., by assessing (e.g., detecting or measuring) a level (e.g., an increased or decreased level, relative to a control), of expression and/or secretion of one or more immune mediators; and j) identifying one or more tumor antigens that stimulate, inhibit and/or suppress, and/or have a minimal effect on a level of expression and/or secretion of one or more immune mediators, to obtain or generate the target response profile. In some embodiments, the target response profile comprises a representation of the level of expression and/or secretion of the one or more immune mediators associated with the plurality of tumor antigens.

In some embodiments, the target response profile is from one or more target subjects who exhibit or previously exhibited at least one beneficial response to cancer. In some embodiments, the beneficial response comprises a positive clinical response to a cancer therapy or combination of therapies. In some embodiments, the beneficial response comprises a spontaneous response to a cancer. In some embodiments, the beneficial response comprises clearance of a cancer, e.g., a level of one or more clinical measures associated with clearance of a cancer. In some embodiments, the beneficial response comprises a lack of a relapse, recurrence, and/or metastasis of a cancer, e.g., over a defined period of time (e.g., at least 1, 2, 3, 4, 5, 6, 7, 8, 9, 10, 11, 12 weeks, or at least 1, 2, 3, 4, 5, 6, 7, 8, 9, 10, 11, 12 months, or at least 1, 2, 3, 4, 5, 6, 7, 8, 9, 10, 11, 12 years). In some embodiments, the beneficial response comprises a positive cancer prognosis. In some embodiments, the beneficial response comprises a lack of one or more toxic responses and/or side effects (e.g., one or more measurable toxic responses or side effects) to a cancer therapy or combination of therapies.

In some embodiments, the target response profile is from one or more target subjects who exhibit or previously exhibited one or more deleterious and/or non-beneficial response to cancer. In some embodiments, the deleterious and/or non-beneficial response comprises a negative clinical response and/or a failure to respond, to a cancer therapy or combination of therapies. In some embodiments, the deleterious and/or non-beneficial response comprises a lack of clearance of a cancer, e.g., a level of one or more clinical measures associated with lack of clearance of a cancer. In some embodiments, the deleterious and/or non-beneficial response comprises at least one relapse, recurrence, and/or metastasis of a cancer. In some embodiments, the deleterious and/or non-beneficial response comprises a negative cancer prognosis. In some embodiments, the deleterious and/or non-beneficial response comprises one or more toxic responses and/or side effects (e.g., one or more measurable toxic responses and/or side effects) to a cancer therapy or combination of therapies.

In some embodiments, the method further comprises selecting the candidate subject for initiation of a cancer therapy or combination of cancer therapies. In some embodiments, the method further comprises selecting the candidate subject for continuation of a cancer therapy or combination of cancer therapies. In some embodiments, the method comprises selecting the subject as a candidate subject (i) if the subject response profile is similar to the target response profile from a target subject who exhibits or previously exhibited one or more beneficial responses to the cancer therapy or combination, and/or (ii) if the subject response profile is dissimilar to the target response profile from a target subject who exhibits or previously exhibited one or more deleterious responses to the cancer therapy or combination. In some embodiments, the method further comprises administering the cancer therapy or combination of cancer therapies to the candidate subject.

In some embodiments, the method further comprises selecting the candidate subject for modification of a cancer therapy. In some embodiments, the method further comprises selecting the candidate subject for discontinuation or non-initiation of a cancer therapy. In some embodiments, the method further comprises selecting the subject as a candidate subject for modification, discontinuation, and/or non-initiation of a cancer therapy (i) if the subject response profile is similar to the target response profile from a target subject who exhibits or previously exhibited one or more deleterious responses to the cancer therapy, and/or (ii) if the subject response profile is dissimilar to the target response profile from a target subject who exhibits or previously exhibited one or more beneficial responses to the cancer therapy. In some embodiments, the method further comprises modifying the cancer therapy administered to the candidate subject. In some embodiments, the method further comprises discontinuing or not initiating the cancer therapy to the candidate subject.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of selecting tumor antigens. In some embodiments, the, method comprises: a) obtaining, providing, or generating a library comprising bacterial cells or beads comprising a plurality of tumor antigens, wherein each bacterial cell or bead of the library comprises a different tumor antigen; b) contacting the bacterial cells or beads with antigen presenting cells (APCs) from a subject, wherein the APCs internalize the bacterial cells or beads; c) contacting the APCs with lymphocytes from the subject, under conditions suitable for activation of lymphocytes by a tumor antigen presented by one or more APCs; d) determining whether one or more lymphocytes are activated by, or not responsive to, one or more tumor antigens presented by one or more APCs, e.g., by assessing (e.g., detecting or measuring) a level) e.g., an increased or decreased level, relative to a control), of expression and/or secretion of one or more immune mediators; e) identifying one or more tumor antigens that stimulate, inhibit and/or suppress, and/or have minimal effect on a level of expression and/or secretion of one or more immune mediators, to obtain or generate a subject response profile; f) comparing the subject response profile to a target response profile; and g) selecting one or more tumor antigens based on the comparison. In some embodiments, the subject response profile comprises a representation of the level of expression and/or secretion of the one or more immune mediators associated with the plurality of tumor antigens.

In some embodiments, the method further comprises generating the target response profile by a method comprising: h) contacting the bacterial cells or beads with antigen presenting cells (APCs) from a target subject, wherein the APCs internalize the bacterial cells or beads; i) contacting the APCs with lymphocytes from the target subject, under conditions suitable for activation of lymphocytes by a tumor antigen presented by one or more APCs; j) determining whether one or more lymphocytes are activated by, or not responsive to, one or more tumor antigens presented by one or more APCs, e.g., by assessing (e.g., detecting or measuring) a level (e.g., an increased or decreased level, relative to a control), of expression and/or secretion of one or more immune mediators; and k) identifying one or more tumor antigens that stimulate, inhibit and/or suppress, and/or have a minimal effect on a level of expression and/or secretion of one or more immune mediators, to obtain or generate the target response profile. In some embodiments, the target response profile comprises a representation of the level of expression and/or secretion of the one or more immune mediators associated with the plurality of tumor antigens.

In some embodiments, the target response profile is from one or more target subjects who exhibit or previously exhibited one or more beneficial response to cancer. In some embodiments, the beneficial response comprises a positive clinical response to a cancer therapy or combination of therapies. In some embodiments, the beneficial response comprises a spontaneous response to a cancer. In some embodiments, the beneficial response comprises clearance of a cancer, e.g., a level of one or more clinical measures associated with clearance of a cancer. In some embodiments, the beneficial response comprises a relapse, recurrence, and/or metastasis of a cancer e.g., over a defined period of time (e.g., at least 1, 2, 3, 4, 5, 6, 7, 8, 9, 10, 11, 12 weeks, or at least 1, 2, 3, 4, 5, 6, 7, 8, 9, 10, 11, 12 months, or at least 1, 2, 3, 4, 5, 6, 7, 8, 9, 10, 11, 12 years). In some embodiments, the beneficial response comprises a positive cancer prognosis. In some embodiments, the beneficial response comprises a lack of one or more toxic responses and/or side effects (e.g., one or more measurable toxic responses and/or side effects) to a cancer therapy or combination of therapies.

In some embodiments, the target response profile is from one or more target subjects who exhibit or previously exhibited one or more deleterious or non-beneficial response to cancer. In some embodiments, the deleterious and/or non-beneficial response comprises a negative clinical response and/or a failure to respond, to a cancer therapy or combination of therapies. In some embodiments, the deleterious and/or non-beneficial response comprises a lack of clearance of a cancer, e.g., a level of one or more clinical measures associated with lack of clearance of a cancer. In some embodiments, the deleterious and/or non-beneficial response comprises at least one relapse, recurrence, and/or metastasis of a cancer. In some embodiments, the deleterious and/or non-beneficial response comprises a negative cancer prognosis. In some embodiments, the deleterious and/or non-beneficial response comprises one or more toxic responses and/or side effects (e.g., one or more measurable toxic responses and/or side effects) to a cancer therapy or combination of therapies.

In some embodiments, the method further comprises selecting (i) one or more tumor antigens that increase level of expression and/or secretion of one or more immune mediators associated with a beneficial response to cancer, and/or (ii) one or more tumor antigens that inhibit and/or suppress level of expression and/or secretion of one or more immune mediators associated with deleterious or not beneficial responses to cancer. In some embodiments, the method further comprises administering to the subject an immunogenic composition comprising one or more of the selected antigens or immunogenic fragments thereof. In some embodiments, the method further comprises administering to the subject a cancer therapy or combination of therapies.

In some embodiments, the method further comprises selecting (i) one or more tumor antigens that increase level of expression and/or secretion of one or more immune mediators associated with deleterious or not beneficial responses to cancer, and/or (ii) one or more tumor antigens that inhibit and/or suppress level of expression and/or secretion of one or more immune mediators associated with beneficial responses to cancer. In some embodiments, the method further comprises administering to the subject an immunogenic composition that does not comprise one or more of the selected antigens or immunogenic fragments thereof. In some embodiments, the method further comprises administering to the subject a cancer therapy or combination of therapies.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of inducing an immune response in a subject. In some embodiments, the method comprises: a) obtaining, providing, or generating a library comprising bacterial cells or beads comprising a plurality of tumor antigens, wherein each bacterial cell or bead of the library comprises a different tumor antigen; b) contacting the bacterial cells or beads with antigen presenting cells (APCs) from a subject, wherein the APCs internalize the bacterial cells or beads; c) contacting the APCs with lymphocytes from the subject, under conditions suitable for activation of lymphocytes by a tumor antigen presented by one or more APCs; d) determining whether one or more lymphocytes are activated by, or not responsive to, one or more tumor antigens presented by one or more APCs, e.g., by assessing (e.g., detecting or measuring) a level (e.g., an increased level or decreased level, relative to a control) of expression and/or secretion of one or more immune mediators; e) identifying one or more tumor antigens that stimulate, inhibit and/or suppress, and/or have a minimal effect on a level of expression and/or secretion of one or more immune mediators, to obtain or generate a subject response profile; f) comparing the subject response profile to a target response profile; g) selecting one or more tumor antigens based on the comparison; and h) administering to the subject an immunogenic composition comprising one or more of the selected antigens or immunogenic fragment thereof. In some embodiments, the subject response profile comprises a representation of the level of expression and/or secretion of the one or more immune mediators associated with the plurality of tumor antigens.

In some embodiments, the method further comprises generating the target response profile by a method comprising: i) contacting the bacterial cells or beads with antigen presenting cells (APCs) from a target subject, wherein the APCs internalize the bacterial cells or beads; j) contacting the APCs with lymphocytes from the target subject, under conditions suitable for activation of lymphocytes by a tumor antigen presented by one or more APCs; k) determining whether one or more lymphocytes are activated by, or not responsive to, one or more tumor antigens presented by one or more APCs, e.g., by assessing (e.g., detecting or measuring) a level (e.g., an increased or decreased level, relative to a control), of expression and/or secretion of one or more immune mediators; and l) identifying one or more tumor antigens that stimulate, inhibit and/or suppress, and/or have a minimal effect on a level of expression and/or secretion of one or more immune mediators, to obtain or generate the target response profile. In some embodiments, the target response profile comprises a representation of the level of expression and/or secretion of the one or more immune mediators associated with the plurality of tumor antigens.

In some embodiments, the target response profile is from one or more target subjects who exhibit or previously exhibited at least one beneficial response to cancer. In some embodiments, the beneficial response comprises a positive clinical response to a cancer therapy or combination of therapies. In some embodiments, the beneficial response comprises a spontaneous response to a cancer. In some embodiments, the beneficial response comprises clearance of a cancer, e.g., a level of one or more clinical measures associated with clearance of a cancer. In some embodiments, the beneficial response comprises a lack of a relapse, recurrence, and/or metastasis of a cancer, e.g., over a defined period of time (e.g., at least 1, 2, 3, 4, 5, 6, 7, 8, 9, 10, 11, 12 weeks, or at least 1, 2, 3, 4, 5, 6, 7, 8, 9, 10, 11, 12 months, or at least 1, 2, 3, 4, 5, 6, 7, 8, 9, 10, 11, 12 years). In some embodiments, the beneficial response comprises a positive cancer prognosis. In some embodiments, the beneficial response comprises a lack of one or more toxic responses and/or side effects (e.g., one or more measurable toxic responses or side effects) to a cancer therapy or combination of therapies.

In some embodiments, the method further comprises selecting and administering to the subject (i) one or more tumor antigens that increase level of expression and/or secretion of one or more immune mediators associated with one or more beneficial responses to cancer, and/or (i) one or more tumor antigens that inhibit and/or suppress level of expression and/or secretion of one or more immune mediators associated with one or more deleterious or not beneficial responses to cancer.

In some embodiments, the method further comprises administering to the subject a cancer therapy or combination of therapies.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of inducing an immune response in a subject. In some embodiments, the method comprises: a) obtaining, providing, or generating a library comprising bacterial cells or beads comprising a plurality of tumor antigens, wherein each bacterial cell or bead of the library comprises a different tumor antigen; b) contacting the bacterial cells or beads with antigen presenting cells (APCs) from a subject, wherein the APCs internalize the bacterial cells or beads; c) contacting the APCs with lymphocytes from the subject, under conditions suitable for activation of lymphocytes by a tumor antigen presented by one or more APCs; d) determining whether one or more lymphocytes are activated by, or not responsive to, one or more tumor antigens presented by one or more APCs, e.g., by assessing (e.g., detecting or measuring) a level (e.g., an increased or decreased level, relative to a control) of expression and/or secretion of one or more immune mediators; e) identifying one or more tumor antigens that stimulate, inhibit and/or suppress, and/or have a minimal effect on a level of expression and/or secretion of one or more immune mediators, to obtain or generate a subject response profile; f) comparing the subject response profile to a target response profile; g) selecting one or more tumor antigens based on the comparison; and h) administering to the subject an immunogenic composition that does not comprise one or more of the selected antigens or immunogenic fragment thereof. In some embodiments, the subject response profile comprises a representation of the level of expression and/or secretion of the one or more immune mediators associated with the plurality of tumor antigens.

In some embodiments, the method further comprises generating the target response profile by a method comprising: i) contacting the bacterial cells or beads with antigen presenting cells (APCs) from a target subject, wherein the APCs internalize the bacterial cells or beads; j) contacting the APCs with lymphocytes from the target subject, under conditions suitable for activation of lymphocytes by a tumor antigen presented by one or more APCs; k) determining whether one or more lymphocytes are activated by, or not responsive to, one or more tumor antigens presented by one or more APCs, e.g., by assessing (e.g., detecting or measuring) a level (e.g., an increased or decreased level, relative to a control), of expression and/or secretion of one or more immune mediators; and l) identifying one or more tumor antigens that stimulate, inhibit and/or suppress, and/or have a minimal effect on a level of expression and/or secretion of one or more immune mediators, to obtain or generate the target response profile. In some embodiments, the target response profile comprises a representation of the level of expression and/or secretion of the one or more immune mediators associated with the plurality of tumor antigens.

In some embodiments, the target response profile is from one or more target subjects who exhibit or previously exhibited one or more deleterious and/or non-beneficial response to cancer. In some embodiments, the deleterious and/or non-beneficial response comprises a negative clinical response and/or a failure to respond, to a cancer therapy or combination of therapies. In some embodiments, the deleterious and/or non-beneficial response comprises a lack of clearance of a cancer, e.g., a level of one or more clinical measures associated with lack of clearance of a cancer. In some embodiments, the deleterious and/or non-beneficial response comprises at least one relapse, recurrence, and/or metastasis of a cancer. In some embodiments, the deleterious and/or non-beneficial response comprises a negative cancer prognosis. In some embodiments, the deleterious and/or non-beneficial response comprises one or more toxic responses and/or side effects (e.g., one or more measurable toxic responses and/or side effects) to a cancer therapy or combination of therapies.

In some embodiments, the method further comprises selecting one or more tumor antigens that increase expression or secretion of immune mediators associated with deleterious or not beneficial responses to cancer, and/or one or more tumor antigens that inhibit and/or suppress expression or secretion of immune mediators associated with beneficial responses to cancer.

In some embodiments, the method further comprises administering to the subject a cancer therapy or combination of therapies.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of selecting tumor antigens. In some embodiments, the method comprises: a) obtaining, providing, or generating a library comprising bacterial cells or beads comprising a plurality of tumor antigens, wherein each bacterial cell or bead of the library comprises a different tumor antigen; b) contacting the bacterial cells or beads with antigen presenting cells (APCs) from a subject, wherein the APCs internalize the bacterial cells or beads; c) contacting the APCs with lymphocytes from the subject, under conditions suitable for activation of lymphocytes by a tumor antigen presented by one or more APCs; d) determining whether one or more lymphocytes are activated by one or more tumor antigens presented by one or more APCs by assessing (e.g., detecting or measuring) a level (e.g., an increased or decreased level, relative to a control) of expression and/or secretion of one or more immune mediators; e) identifying one or more tumor antigens that stimulate, inhibit and/or suppress, and/or have a minimal effect on a level of expression and/or secretion of one or more immune mediators, to obtain a subject response profile; and f) selecting from among the identified tumor antigens one or more antigens that increase a level of expression and/or secretion of one or more immune mediators associated with at least one beneficial response to cancer, and/or selecting one or more tumor antigens that inhibit and/or suppress a level of expression and/or secretion of one or more immune mediators associated with at least one deleterious and/or non-beneficial response to cancer.

In some embodiments, the method further comprises comparing the subject response profile to a target response profile, e.g., a target response profile generated using a method described herein, and selecting one or more tumor antigens based on the comparison.

In some embodiments, the target response profile is from one or more target subjects who exhibit or previously exhibited at least one beneficial response to cancer. In some embodiments, the beneficial response comprises a positive clinical response to a cancer therapy or combination of therapies. In some embodiments, the beneficial response comprises a spontaneous response to a cancer. In some embodiments, the beneficial response comprises clearance of a cancer, e.g., a level of one or more clinical measures associated with clearance of a cancer. In some embodiments, the beneficial response comprises a lack of a relapse, recurrence, and/or metastasis of a cancer, e.g., over a defined period of time (e.g., at least 1, 2, 3, 4, 5, 6, 7, 8, 9, 10, 11, 12 weeks, or at least 1, 2, 3, 4, 5, 6, 7, 8, 9, 10, 11, 12 months, or at least 1, 2, 3, 4, 5, 6, 7, 8, 9, 10, 11, 12 years). In some embodiments, the beneficial response comprises a positive cancer prognosis. In some embodiments, the beneficial response comprises a lack of one or more toxic responses and/or side effects (e.g., one or more measurable toxic responses or side effects) to a cancer therapy or combination of therapies.

In some embodiments, the method further comprises administering to the subject an immunogenic composition comprising one or more of the selected antigens or immunogenic fragments thereof.

In some embodiments, the method further comprises administering to the subject a cancer therapy or combination of therapies.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of selecting tumor antigens. In some embodiments, the method comprises a) obtaining, providing, or generating a library comprising bacterial cells or beads comprising a plurality of tumor antigens, wherein each bacterial cell or bead of the library comprises a different tumor antigen; b) contacting the bacterial cells or beads with antigen presenting cells (APCs) from a subject, wherein the APCs internalize the bacterial cells or beads; c) contacting the APCs with lymphocytes from the subject, under conditions suitable for activation of lymphocytes by a tumor antigen presented by one or more APCs; d) determining whether one or more lymphocytes are activated by one or more tumor antigens presented by one or more APCs by assessing (e.g., detecting or measuring) a level (e.g., an increased or decreased level, relative to a control) of expression and/or secretion of one or more immune mediators; e) identifying one or more tumor antigens that stimulate, inhibit and/or suppress, and/or have a minimal effect on a level of expression and/or secretion of one or more immune mediators, to obtain a subject response profile; and f) selecting from among the identified tumor antigens (i) one or more antigens that increase a level of expression and/or secretion of one or more immune mediators associated with at least one deleterious and/or non-beneficial response to cancer, and/or (ii) one or more tumor antigens that inhibit and/or suppress a level of expression and/or secretion of one or more immune mediators associated with at least one beneficial response to cancer.

In some embodiments, the method further comprises comparing the subject response profile to a target response profile, e.g., a target response profile generated using a method described herein, and selecting one or more tumor antigens based on the comparison.

In some embodiments, the target response profile is from one or more target subjects who exhibit or previously exhibited one or more deleterious and/or non-beneficial response to cancer. In some embodiments, the deleterious and/or non-beneficial response comprises a negative clinical response and/or a failure to respond, to a cancer therapy or combination of therapies. In some embodiments, the deleterious and/or non-beneficial response comprises a lack of clearance of a cancer, e.g., a level of one or more clinical measures associated with lack of clearance of a cancer. In some embodiments, the deleterious and/or non-beneficial response comprises at least one relapse, recurrence, and/or metastasis of a cancer. In some embodiments, the deleterious and/or non-beneficial response comprises a negative cancer prognosis. In some embodiments, the deleterious and/or non-beneficial response comprises one or more toxic responses and/or side effects (e.g., one or more measurable toxic responses and/or side effects) to a cancer therapy or combination of therapies.

In some embodiments, the method further comprises administering to the subject an immunogenic composition that does not comprise one or more of the selected antigens or immunogenic fragments thereof.

In some embodiments, the method further comprises administering to the subject a cancer therapy or combination of therapies.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of inducing an immune response in a subject. In some embodiments, the method comprises: a) obtaining, providing, or generating a library comprising bacterial cells or beads comprising a plurality of tumor antigens, wherein each bacterial cell or bead of the library comprises a different tumor antigen; b) contacting the bacterial cells or beads with antigen presenting cells (APCs) from a subject, wherein the APCs internalize the bacterial cells or beads; c) contacting the APCs with lymphocytes from the subject, under conditions suitable for activation of lymphocytes by a tumor antigen presented by one or more APCs; d) determining whether one or more lymphocytes are activated by, or not responsive to, one or more tumor antigens presented by one or more APCs, e.g., by assessing (e.g., detecting or measuring) a level (e.g., an increased or decreased level, relative to a control), of expression and/or secretion of one or more immune mediators; e) identifying one or more tumor antigens that stimulate, inhibit and/or suppress, and/or have a minimal effect on a level of expression and/or secretion of one or more immune mediators, to obtain a subject response profile; f) selecting from among the identified tumor antigens (i) one or more antigens that increase level of expression and/or secretion of one or more immune mediators associated with at least one beneficial response to cancer, and/or (ii) one or more tumor antigens that inhibit and/or suppress level of expression and/or secretion of one or more immune mediators associated with at least one deleterious or non-beneficial response to cancer; and g) administering to the subject an immunogenic composition comprising one or more of the selected antigens or immunogenic fragment thereof.

In some embodiments, the method further comprises comparing the subject response profile to a target response profile, e.g., a target response profile generated using a method described herein, and selecting one or more tumor antigens based on the comparison, prior to administration of the immunogenic composition.

In some embodiments, the target response profile is from one or more target subjects who exhibit or previously exhibited at least one beneficial response to cancer. In some embodiments, the beneficial response comprises a positive clinical response to a cancer therapy or combination of therapies. In some embodiments, the beneficial response comprises a spontaneous response to a cancer. In some embodiments, the beneficial response comprises clearance of a cancer, e.g., a level of one or more clinical measures associated with clearance of a cancer. In some embodiments, the beneficial response comprises a lack of a relapse, recurrence, and/or metastasis of a cancer, e.g., over a defined period of time (e.g., at least 1, 2, 3, 4, 5, 6, 7, 8, 9, 10, 11, 12 weeks, or at least 1, 2, 3, 4, 5, 6, 7, 8, 9, 10, 11, 12 months, or at least 1, 2, 3, 4, 5, 6, 7, 8, 9, 10, 11, 12 years). In some embodiments, the beneficial response comprises a positive cancer prognosis. In some embodiments, the beneficial response comprises a lack of one or more toxic responses and/or side effects (e.g., one or more measurable toxic responses or side effects) to a cancer therapy or combination of therapies.

In some embodiments, the method further comprises administering to the subject a cancer therapy or combination of therapies.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of inducing an immune response in a subject. In some embodiments, the method comprises: a) obtaining, providing, or generating a library comprising bacterial cells or beads comprising a plurality of tumor antigens, wherein each bacterial cell or bead of the library comprises a different tumor antigen; b) contacting the bacterial cells or beads with antigen presenting cells (APCs) from a subject, wherein the APCs internalize the bacterial cells or beads; c) contacting the APCs with lymphocytes from the subject, under conditions suitable for activation of lymphocytes by a tumor antigen presented by one or more APCs; d) determining whether one or more lymphocytes are activated by, or not responsive to, one or more tumor antigens presented by one or more APCs, e.g., by assessing e.g., detecting or measuring) a level (e.g., an increased or decreased level, relative to a control). of expression and/or secretion of one or more immune mediators; e) identifying one or more tumor antigens that stimulate, inhibit and/or suppress, and/or have a minimal effect on level of expression and/or secretion of one or more immune mediators, to obtain a subject response profile; f) comparing the subject response profile to a target response profile, e.g., a target response profile generated using a method described herein; g) selecting from among the identified tumor antigens (i) one or more antigens that increase level of expression and/or secretion of one or more immune mediators associated with at least one deleterious and/or non-beneficial response to cancer, and/or (ii) one or more tumor antigens that inhibit and/or suppress level of expression and/or secretion of one or more immune mediators associated with at least one beneficial response to cancer; and h) administering to the subject an immunogenic composition that does not comprise one or more of the selected antigens or immunogenic fragment thereof.

In some embodiments, the method further comprises comparing the subject response profile to a target response profile e.g., a target response profile generated using a method described herein, and selecting one or more tumor antigens based on the comparison.

In some embodiments, the target response profile is from one or more target subjects who exhibit or previously exhibited one or more deleterious and/or non-beneficial response to cancer. In some embodiments, the deleterious and/or non-beneficial response comprises a negative clinical response and/or a failure to respond, to a cancer therapy or combination of therapies. In some embodiments, the deleterious and/or non-beneficial response comprises a lack of clearance of a cancer, e.g., a level of one or more clinical measures associated with lack of clearance of a cancer. In some embodiments, the deleterious and/or non-beneficial response comprises at least one relapse, recurrence, and/or metastasis of a cancer. In some embodiments, the deleterious and/or non-beneficial response comprises a negative cancer prognosis. In some embodiments, the deleterious and/or non-beneficial response comprises one or more toxic responses and/or side effects (e.g., one or more measurable toxic responses and/or side effects) to a cancer therapy or combination of therapies.

In some embodiments, the method further comprises administering to the subject a cancer therapy or combination of therapies.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of identifying tumor antigens. In some embodiments, the method comprises: a) obtaining, providing, or generating a library comprising bacterial cells or beads, wherein each bacterial cell or bead of the library comprises a different heterologous polypeptide comprising one or more mutations, splice variants, or translocations expressed in a cancer or tumor cell of a subject; b) contacting the bacterial cells or beads with antigen presenting cells (APCs) from the subject, wherein the APCs internalize the bacterial cells or beads; c) contacting the APCs with lymphocytes from the subject, under conditions suitable for activation of lymphocytes by a polypeptide presented by one or more APCs; d) determining whether one or more lymphocytes are activated by, or not responsive to, one or more polypeptides presented by one or more APCs, e.g., by assessing (e.g., detecting or measuring) a level (e.g., an increased or decreased level, relative to a control) of expression and/or secretion of one or more immune mediators; and e) identifying one or more polypeptides that stimulate, inhibit and/or suppress, and/or have a minimal effect on level of expression and/or secretion of one or more immune mediators, wherein stimulation, inhibition and/or suppression indicate that the polypeptide is a tumor antigen.

In another aspect, the disclosure features a method of selecting tumor antigens. In some embodiments, the method comprises: a) providing a library comprising bacterial cells or beads, wherein each bacterial cell or bead of the library comprises a different heterologous polypeptide comprising one or more mutations, splice variants, or translocations expressed in a cancer or tumor cell expressed in a cancer or tumor cell of a subject; b) contacting the bacterial cells or beads with antigen presenting cells (APCs) from the subject, wherein the APCs internalize the bacterial cells or beads; c) contacting the APCs with lymphocytes from the subject, under conditions suitable for activation of lymphocytes by a polypeptide presented by one or more APCs; d) determining whether one or more lymphocytes are activated by, or not responsive to, one or more polypeptides presented by one or more APCs, e.g., by assessing (e.g., detecting or measuring) a level (e.g., an increased or decreased level, relative to a control), of expression and/or secretion of one or more immune mediators; e) identifying one or more polypeptides that stimulate, inhibit and/or suppress, and/or have a minimal effect on level of expression and/or secretion of one or more immune mediators, wherein stimulation, inhibition and/or suppression indicate that the polypeptide is a tumor antigen; and f) selecting from among the identified tumor antigens (i) one or more tumor antigens that increase level of expression and/or secretion of one or more immune mediators associated with at least one beneficial response to cancer, and/or (ii) one or more tumor antigens that inhibit and/or suppress level of expression and/or secretion of one or more immune mediators associated with at least one deleterious and/or non-beneficial response to cancer.

In some embodiments, the method further comprises selecting from among the identified polypeptides one of more polypeptides that have a minimal effect on level of expression and/or secretion of one of more immune mediators.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of selecting potential tumor antigens. In some embodiments, the method comprises: a) obtaining, providing, or generating a library comprising bacterial cells or beads, wherein each bacterial cell or bead of the library comprises a heterologous polypeptide comprising one or more mutations, splice variants, or translocations expressed in a cancer or tumor cell expressed in a cancer or tumor cell of a subject; b) contacting the bacterial cells or beads with antigen presenting cells (APCs) from the subject, wherein the APCs internalize the bacterial cells or beads; c) contacting the APCs with lymphocytes from the subject, under conditions suitable for activation of lymphocytes by a polypeptide presented by one or more APCs; d) determining whether one or more lymphocytes are activated by, or not responsive to, one or more polypeptides presented by one or more APCs, e.g., by assessing (e.g., detecting or measuring) a level (e.g., an increased or decreased level, relative to a control) of expression and/or secretion of one or more immune mediators; e) identifying one or more polypeptides that stimulate, inhibit and/or suppress, and/or have a minimal effect on level of expression and/or secretion of one or more immune mediators, and identifying one or more polypeptides that stimulate, inhibit, and/or suppress as a tumor antigen; and f) selecting from among the identified polypeptides one or more polypeptides that have a minimal effect on level of expression and/or secretion of one or more immune mediators.

In some embodiments, the method further comprises repeating steps b) through e), or steps c) through e), with lymphocytes from the subject that have undergone one or more previous rounds of exposure to APCs.

In some embodiments, the method further comprises selecting from among the identified tumor antigens (i) one or more tumor antigens that increase level of expression and/or secretion of one or more immune mediators associated with at least one beneficial response to cancer, and/or (ii) one or more tumor antigens that inhibit and/or suppress level of expression and/or secretion of one or more immune mediators associated with at least one deleterious and/or non-beneficial responses to cancer.

In some embodiments, the method further comprises administering to the subject an immunogenic composition comprising one or more of the selected tumor antigens or selected polypeptides, or immunogenic fragments thereof. In some embodiments, the method further comprises administering to the subject an immunogenic composition comprising a combination of one or more of the selected tumor antigens and selected polypeptides, or immunogenic fragments thereof. In some embodiments, the method further comprises administering to the subject a cancer therapy or combination of therapies.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of selecting tumor antigens. In some embodiments, the method comprises: a) obtaining, providing, or generating a library comprising bacterial cells or beads, wherein each bacterial cell or bead of the library comprises a different heterologous polypeptide comprising one or more mutations, splice variants, or translocations expressed in a cancer or tumor cell expressed in a cancer or tumor cell of a subject; b) contacting the bacterial cells or beads with antigen presenting cells (APCs) from the subject, wherein the APCs internalize the bacterial cells or beads; c) contacting the APCs with lymphocytes from the subject, under conditions suitable for activation of lymphocytes by a polypeptide presented by one or more APCs; d) determining whether one or more lymphocytes are activated by, or not responsive to, one or more polypeptides presented by one or more APCs, e.g., by assessing (e.g., detecting or measuring) a level (e.g., an increased or decreased level, relative to a control), of expression and/or secretion of one or more immune mediators; e) identifying one or more polypeptides that stimulate, inhibit and/or suppress, and/or have a minimal effect on level of expression and/or secretion of one or more immune mediators, and identifying one or more polypeptides that stimulate, inhibit, and/or suppress as a tumor antigen; and f) selecting from among the identified tumor antigens (i) one or more tumor antigens that increase level of expression and/or secretion of one or more immune mediators associated with at least one deleterious and/or non-beneficial response to cancer, and/or (ii) one or more tumor antigens that inhibit and/or suppress level of expression and/or secretion of one or more immune mediators associated with at least one beneficial response to cancer.

In some embodiments, the method further comprises administering to the subject an immunogenic composition that does not comprise one or more of the selected tumor antigens or immunogenic fragments thereof. In some embodiments, the method further comprises administering to the subject a cancer therapy or combination of therapies.

In some embodiments, the APCs are human APCs isolated from the subject; and/or the bacterial cells further comprise a cytolysin polypeptide; and/or the cytolysin polypeptide is listeriolysin O (LLO); and/or the APCs are provided in an array, and/or the APCs in each location of the array are contacted with a set of bacterial cells, each set comprising a different tumor antigen; and/or the APCs and lymphocytes are isolated from peripheral blood; and/or the APCs comprise immortalized cells; and/or the lymphocytes are derived from a cancer or tumor.

In some embodiments, the tumor antigens comprise full length polypeptides encoding mutations, splice variants, or translocations present in a cancer or tumor; and/or the tumor antigens comprise polypeptides that are fragments of full length polypeptides encoding mutations, splice variants, or translocations present in a cancer or tumor; and/or the tumor antigens comprise full length polypeptides encoded by a virus or other infectious agent present in a cancer or tumor; and/or the tumor antigens comprise polypeptides that are fragments of full length polypeptides encoded by a virus or other infectious agent present in a cancer or tumor; and/or the tumor antigens comprise full length polypeptides encoding autoantigens associated with a cancer or tumor; and/or the tumor antigens comprise polypeptides that are fragments of full length polypeptides encoding autoantigens associated with a cancer or tumor.

In another aspect, the disclosure features a method of inducing an immune response in a subject. In some embodiments, the method comprises: a) obtaining, providing, or generating a library comprising bacterial cells or beads, wherein each bacterial cell or bead of the library comprises a different heterologous polypeptide comprising one or more mutations, splice variants, or translocations expressed in a cancer or tumor cell of a subject; b) contacting the bacterial cells or beads with antigen presenting cells (APCs) from the subject, wherein the APCs internalize the bacterial cells or beads; c) contacting the APCs with lymphocytes from the subject, under conditions suitable for activation of lymphocytes by a polypeptide presented by one or more APCs; d) determining whether one or more lymphocytes are activated by, or not responsive to, one or more polypeptides presented by one or more APCs, e.g., by assessing (e.g., detecting or measuring) a level (e.g., an increased or decreased level, relative to a control) of expression and/or secretion of one or more immune mediators; e) identifying one or more polypeptides that stimulate, inhibit and/or suppress, and/or have a minimal effect on level of expression and/or secretion of one or more immune mediators, and identifying a polypeptide that stimulates, inhibits and/or suppresses as a tumor antigen; f) selecting from among the identified tumor antigens (i) one or more tumor antigens that increase level of expression and/or secretion of one or more immune mediators associated with at least one beneficial response to cancer, and/or (ii) one or more tumor antigens that inhibit and/or suppress level of expression and/or secretion of one or more immune mediators associated with at least one deleterious and/or non-beneficial responses to cancer; and g) administering to the subject an immunogenic composition comprising one or more of the selected antigens or immunogenic fragment thereof.

In another aspect, the disclosure features a method of inducing an immune response in a subject. In some embodiments, the method comprises: a) obtaining, providing, or generating a library comprising bacterial cells or beads, wherein each bacterial cell or bead of the library comprises a different heterologous polypeptide comprising one or more mutations, splice variants, or translocations expressed in a cancer or tumor cell of a subject; b) contacting the bacterial cells or beads with antigen presenting cells (APCs) from the subject, wherein the APCs internalize the bacterial cells or beads; c) contacting the APCs with lymphocytes from the subject, under conditions suitable for activation of lymphocytes by a polypeptide presented by one or more APCs; d) determining whether one or more lymphocytes are activated by, or not responsive to, one or more polypeptides presented by one or more APCs, e.g., by assessing (e.g., detecting or measuring) a level (e.g., an increased or decreased level, relative to a control), of expression and/or secretion of one or more immune mediators; e) identifying one or more polypeptides that stimulate, inhibit and/or suppress, and/or have a minimal effect on level of expression and/or secretion of one or more immune mediators, wherein stimulation, inhibition and/or suppression indicate that the polypeptide is a tumor antigen; f) selecting from among the identified polypeptides one or more polypeptides that have a minimal effect on level of expression and/or secretion of one or more immune mediators; and g) administering to the subject an immunogenic composition comprising one or more of the selected polypeptides or immunogenic fragment thereof.

In another aspect, the disclosure features a method of inducing an immune response in a subject. In some embodiments, the method comprises: a) obtaining, providing, or generating a library comprising bacterial cells or beads, wherein each bacterial cell or bead of the library comprises a different heterologous polypeptide comprising one or more mutations, splice variants, or translocations expressed in a cancer or tumor cell of a subject; b) contacting the bacterial cells or beads with antigen presenting cells (APCs) from the subject, wherein the APCs internalize the bacterial cells or beads; c) contacting the APCs with lymphocytes from the subject, under conditions suitable for activation of lymphocytes by a polypeptide presented by one or more APCs; d) determining whether one or more lymphocytes are activated by, or not responsive to, one or more polypeptides presented by one or more APCs, e.g., by assessing (e.g., detecting or measuring) a level (e.g., an increased or decreased level, relative to a control), of expression and/or secretion of one or more immune mediators; e) identifying one or more polypeptides that stimulate, inhibit and/or suppress, and/or have a minimal effect on level of expression and/or secretion of one or more immune mediators, wherein stimulation, inhibition and/or suppression indicate that the polypeptide is a tumor antigen; f) selecting from among the identified tumor antigens and polypeptides (i) one or more polypeptides that have a minimal effect on level of expression and/or secretion of one or more immune mediators, (ii) one or more tumor antigens that increase level of expression and/or secretion of one or more immune mediators associated with at least one beneficial response to cancer; and/or (iii) one or more tumor antigens that inhibit and/or suppress level of expression and/or secretion of one or more immune mediators associated with at least one deleterious and/or non-beneficial response to cancer; and g) administering to the subject an immunogenic composition comprising one or more of the selected tumor antigens and polypeptides, or immunogenic fragments thereof.

In some embodiments, the method further comprises administering to the subject a cancer therapy or combination of therapies.

In another aspect, the disclosure features a method of inducing an immune response in a subject. In some embodiments, the method comprises: a) obtaining, providing, or generating a library comprising bacterial cells or beads, wherein each bacterial cell or bead of the library comprises a different heterologous polypeptide comprising one or more mutations, splice variants, or translocations expressed in a cancer or tumor cell of a subject; b) contacting the bacterial cells or beads with antigen presenting cells (APCs) from the subject, wherein the APCs internalize the bacterial cells or beads; c) contacting the APCs with lymphocytes from the subject, under conditions suitable for activation of lymphocytes by a polypeptide presented by one or more APCs; d) determining whether one or more lymphocytes are activated by, or not responsive to, one or more polypeptides presented by one or more APCs, e.g., by assessing (e.g., detecting or measuring) a level (e.g., an increased or decreased level, relative to a control) of expression and/or secretion of one or more immune mediators; e) identifying one or more polypeptides that stimulate, inhibit and/or suppress, and/or have a minimal effect on level of expression and/or secretion of one or more immune mediators, and identifying a polypeptide that stimulates, inhibits and/or suppresses as a tumor antigen; f) selecting from among the identified tumor antigens (i) one or more tumor antigens that increase level of expression and/or secretion of one or more immune mediators associated with at least one deleterious and/or non-beneficial response to cancer, and/or (ii) one or more tumor antigens that inhibit and/or suppress level of expression and/or secretion of one or more immune mediators associated with at least one beneficial response to cancer; and g) administering to the subject an immunogenic composition that does not comprise one or more of the selected antigens or immunogenic fragment thereof.

In some embodiments, the method further comprises administering to the subject a cancer therapy or combination of therapies.

In any of the aspects described herein, the plurality of tumor antigens comprises at least 1, 3, 5, 10, 15, 20, 25, 30, 50, 100, 150, 250, 500, 750, 1000 or more different tumor antigens, or portions thereof, and/or determining whether one or more lymphocytes are activated by, or not responsive to, one or more tumor antigens comprises measuring a level of one or more immune mediators; and/or the one or more immune mediators are selected from the group consisting of cytokines, soluble mediators, and cell surface markers expressed by the lymphocytes; and/or the one or more immune mediators are cytokines; and/or the one or more cytokines are selected from the group consisting of TRAIL, IFN-gamma, IL-12p70, IL-2, TNF-alpha, MIP1-alpha, MIP1-beta, CXCL9, CXCL10, MCP1, RANTES, IL-1 beta, IL-4, IL-6, IL-8, IL-9, IL-10, IL-13, IL-15, CXCL11, IL-3, IL-5, IL-17, IL-18, IL-21, IL-22, IL-23A, IL-24, IL-27, IL-31, IL-32, TGF-beta, CSF, GM-CSF, TRANCE (also known as RANK L), MIP3-alpha, and fractalkine; and/or the one or more immune mediators are soluble mediators; and/or the one or more soluble mediators are selected from the group consisting of granzyme A, granzyme B, sFas, sFasL, perforin, and granulysin; and/or the one or more immune mediators are cell surface markers; and/or the one or more cell surface markers are selected from the group consisting of CD107a, CD107b, CD25, CD69, CD45RA, CD45RO, CD137 (4-1BB), CD44, CD62L, CD27, CCR7, CD154 (CD40L), KLRG-1, CD71, HLA-DR, CD122 (IL-2RB), CD28, IL7Ra (CD127), CD38, CD26, CD134 (OX-40), CTLA-4 (CD152), LAG-3, TIM-3 (CD366), CD39, PD1 (CD279), FoxP3, TIGIT, CD160, BTLA, 2B4 (CD244), and KLRG1; and/or the lymphocytes comprise CD4+ T cells; and/or the lymphocytes comprise CD8+ T cells; and/or the lymphocytes comprise NKT cells, gamma-delta T cells, or NK cells; and/or the lymphocytes comprise any combination of CD4+ T cells, CD8+ T cells, NKT cells, gamma-delta T cells, and NK cells; and/or lymphocyte activation is determined by assessing a level of one or more expressed or secreted immune mediators that is at least 20%, 40%, 60%, 80%, 100%, 120%, 140%, 160%, 180%, or 200% higher or lower than a control level; and/or lymphocyte activation is determined by assessing a level of one or more expressed or secreted immune mediators that is at least one, two, or three standard deviations greater or lower than the mean of a control level; and/or lymphocyte activating is determined by assessing a level of one or more expressed or secreted immune mediators that is at least 1, 2, 3, 4 or 5 median absolute deviations (MADs) greater or lower than a median response level to a control; and/or lymphocyte non-responsiveness is determined by assessing a level of one or more expressed or secreted immune mediators that is within 5%, 10%, 15%, or 20% of a control level; and/or lymphocyte non-responsiveness is determined by assessing a level of one or more expressed or secreted immune mediators that is less than one or two standard deviation higher or lower than the mean of a control level; and/or lymphocyte non-responsiveness is determined by assessing a level of one or more expressed or secreted immune mediators that is less than one or two median absolute deviation (MAD) higher or lower than a median response level to a control; and/or the subject response profile comprises one or more different tumor antigens that increase level of expression and/or secretion of one or more immune mediators; and/or the subject response profile comprises one or more different tumor antigens that inhibit and/or suppress level of expression and/or secretion of one or more immune mediators; and/or the subject response profile comprises one or more different tumor antigens that have a minimal effect on level of expression and/or secretion of one or more immune mediators; and/or the subject response profile comprises a combination of one or more different tumor antigens that stimulate, inhibit and/or suppress, and/or have a minimal effect on level of expression and/or secretion of one or more immune mediators; and/or the target response profile comprises one or more different tumor antigens that increase level of expression and/or secretion of one or more immune mediators; and/or the target response profile comprises one or more different tumor antigens that inhibit and/or suppress level of expression and/or secretion of one or more immune mediators; and/or the target response profile comprises one or more different tumor antigens that have a minimal effect on level of expression and/or secretion of one or more immune mediators; and/or the target response profile comprises a combination of one or more different tumor antigens that stimulate, inhibit and/or suppress, and/or have a minimal effect on level of expression and/or secretion of one or more immune mediators; and/or the target response profile comprises an average number of different tumor antigens that increase level of expression and/or secretion of one or more immune mediators, from a population of subjects who respond clinically to the cancer therapy, or from subjects who fail to respond clinically to the cancer therapy; and/or the target response profile comprises an average number of different tumor antigens that inhibit and/or suppress level of expression and/or secretion of one or more immune mediators, from a population of subjects who respond clinically to the cancer therapy, or from subjects who fail to respond clinically to the cancer therapy; and/or the target response profile comprises an average number of different tumor antigens that have a minimal effect on level of expression and/or secretion of one or more immune mediators, from a population of subjects who respond clinically to the cancer therapy, or from subjects who fail to respond clinically to the cancer therapy; and/or the target response profile comprises a combination of different tumor antigens that stimulate, inhibit and/or suppress, and/or have a minimal effect on level of expression and/or secretion of one or more immune mediators, from a population of subjects who respond clinically to the cancer therapy, or from a population of subjects who fail to respond clinically to the cancer therapy; and or the subject response profile is similar to the target response profile if the number of tumor antigens of the subject response profile differs by no more than 1, 2, 3, 4, 5, or 10 from the number of antigens of the target response profile; and/or the subject response profile comprises the number of different tumor antigens for each of a plurality of cytokines expressed and/or secreted by activated and/or non-responsive lymphocytes; and/or the target response profile comprises the number of antigens for each of the corresponding plurality of cytokines; and/or the target response profile comprises an average number of antigens for each of the corresponding plurality of cytokines expressed and/or secreted by activated and/or non-responsive lymphocytes from a population of subjects who respond clinically to the cancer therapy; and/or the target response profile comprises an average number of antigens for each of the corresponding plurality of cytokines expressed and/or secreted by activated and/or non-responsive lymphocytes from a population of subjects who fail to respond clinically to the cancer therapy; and/or the target response profile comprises a combination of antigens for each of the corresponding plurality of cytokines expressed and/or secreted by activated and/or non-responsive lymphocytes from a population of subjects who respond clinically to the cancer therapy, or from a population of subjects who fail to respond clinically to the cancer therapy; and/or the subject response profile is similar to the target response profile if the number of tumor antigens for at least two of the plurality of cytokines of the subject response profile differs by no more than 1, 2, 3, 4, 5, or 10 from the number of antigens for the corresponding plurality of cytokines of the target response profile; and/or a subject exhibits at least one measure or indication of clinical responsiveness to the cancer therapy; and/or a subject exhibits at least one measure or indication of failure of clinical responsiveness to the cancer therapy; and/or the cancer therapy comprises immune checkpoint blockade therapy; and/or the immune checkpoint blockade therapy comprises administration of pembrolizumab, nivolumab, ipilimumab, atezolizumab, avelumab, durvalumab, tremelimumab, or cemiplimab; and/or the immune checkpoint blockade therapy comprises administration of two or more immune checkpoint inhibitors; and/or the cancer therapy comprises immune suppression blockade therapy; and/or the immune suppression blockade therapy comprises administration of Vista (B7-H5, v-domain Ig suppressor of T cell activation) inhibitors, Lag-3 (lymphocyte-activation gene 3, CD223) inhibitors, IDO (indolemamine-pyrrole-2,3,-dioxygenase-1,2) inhibitors, or KIR receptor family (killer cell immunoglobulin-like receptor) inhibitors, CD47 inhibitors, or Tigit (T cell immunoreceptor with Ig and ITIM domain) inhibitors; and/or the immune suppression blockade therapy comprises administration of two or more immune suppression inhibitors; and/or the cancer therapy comprises immune activation therapy; and/or the immune activation therapy comprises administration of CD40 agonists, GITR (glucocorticoid-induced TNF-R-related protein, CD357) agonists, OX40 (CD134) agonists, 4-1BB (CD137) agonists, ICOS (inducible T cell stimulator, CD278) agonists, IL-2 (interleukin 2) agonists, or interferon agonists; and/or immune activation comprises administration of two or more immune activators; and/or the cancer therapy comprises adjuvant therapy; and/or the adjuvant therapy comprises administration of a TLR agonist (e.g., CpG or Poly I:C), STING agonist, non-specific stimulus of innate immunity, dendritic cells, GM-CSF, IL-12, IL-7, Flt-3, or other cytokines; and/or the cancer therapy comprises oncolytic virus therapy; and/or the oncolytic viral therapy comprises administration of talimogene leherparepvec; and/or the cancer therapy comprises administration of one or more chemotherapeutic agents; and/or the cancer therapy comprises radiation; and/or the cancer therapy comprises surgical excision; and/or the cancer therapy comprises cell-based therapy; and/or the cell-based therapy comprises administration of dendritic cells, chimeric antigen receptor T (CAR-T) cells, T cell receptor-transduced cells, tumor infiltrating lymphocytes (TIL), or natural killer (NK) cells; and/or the cancer therapy comprises localized hyperthermia or hypothermia; and/or the cancer therapy comprises administration of one or more anti-tumor antibodies; and/or the anti-tumor antibodies comprise bi-specific antibodies; and/or the cancer therapy comprises administration of one or more anti-angiogenic agents; and/or the cancer therapy comprises any combination of immune checkpoint blockade, immune suppression blockade, immune activation, adjuvant, oncolytic virus, chemotherapeutic, radiation, surgical, cell-based, hyperthermia, hypothermia, anti-tumor antibody, and anti-angiogenic therapies.

In another aspect, the disclosure features a method of inducing an immune response in a subject with one or more selected antigens, the method comprising: a) obtaining, providing or generating a library comprising bacterial cells or beads comprising a plurality of tumor antigens, wherein each bacterial cell or bead of the library comprises a different tumor antigen; b) contacting the bacterial cells or beads with antigen presenting cells (APCs) from a first subject, wherein the APCs internalize the bacterial cells or beads; c) contacting the APCs with lymphocytes from the first subject, under conditions suitable for stimulation or inhibition and/or suppression of lymphocytes by a tumor antigen presented by one or more APCs; d) identifying one or more stimulatory tumor antigens that stimulate lymphocytes and identifying one or more non-stimulatory tumor antigens that do not stimulate lymphocytes, to produce a subject response profile; e) comparing the subject response profile to a target response profile, wherein the target response profile is from a second subject who responds clinically to a cancer therapy, and wherein the target response profile comprises one or more identified stimulatory tumor antigens that stimulate lymphocytes and comprises one or more identified non-stimulatory tumor antigens that do not stimulate lymphocytes; f) selecting one or more antigens, wherein the one or more antigens are identified as non-stimulatory in the subject response profile and the same one or more antigens are identified as stimulatory in the target response profile; and g) administering to the first subject an immunogenic composition comprising one or more of the selected antigens.

In some embodiments, the method further comprises administering a cancer therapy to the subject. In some embodiments, the subject response profile comprises a representation of the level of expression and/or secretion of the one or more immune mediators associated with the plurality of tumor antigens.

In another aspect, the disclosure features an immunogenic composition of the invention, comprising one or more antigens of the target response profile obtained or generated according to any of the methods described herein.

In another aspect, the disclosure features an immunogenic composition of the invention, comprising one or more antigens selected according to any of the methods described herein.

In another aspect, the disclosure features an immunogenic composition comprising (i) one or more heparanase polypeptides or immunogenic fragments thereof and (ii) a SMAD4 polypeptide or immunogenic fragment thereof.

In some embodiments, the one or more heparanase polypeptides or fragments and the SMAD4 polypeptide or fragment are each 8-29 amino acids in length. In some embodiments, the heparanase polypeptides comprise the amino acid sequence of SEQ ID NO:6 or SEQ ID NO:7. In some embodiments, the SMAD4 polypeptide comprises the amino acid sequence of SEQ ID NO:8. In some embodiments, the one or more immunogenic fragments consist of about 70%, 75%, 80%, 85%, 90%, 95%, 96%, 97%, 98%, or 99% of the total number of amino acids of SEQ ID NO:6, SEQ ID NO:7, or SEQ ID NO:8. In some embodiments, the one or more immunogenic fragments consist of SEQ ID NO:6, SEQ ID NO:7, or SEQ ID NO:8 lacking about 1, 2, 3, 4, 5, 10, 15, 20, 25, 30, 35, 40, 45, 50, or more amino acids. In some embodiments, the one or more heparanse polypeptides comprise an amino acid sequence at least 85%, 90%, 95%, 97%, or 99% identical to SEQ ID NO:6 or SEQ ID NO:7. In some embodiments, the SMAD4 polypeptide comprises an amino acid sequence at least 85%, 90%, 95%, 97%, or 99% identical to SEQ ID NO:8.

In another aspect, the disclosure features an immunogenic composition comprising a heparanase isoform 1 polypeptide or immunogenic fragment, a heparanase isoform 2 polypeptide or immunogenic fragment, and a SMAD4 polypeptide or immunogenic fragment.

In some embodiments, the heparanase isoform 1 polypeptide or immunogenic fragment, the heparanase isoform 2 polypeptide or immunogenic fragment and the SMAD4 polypeptide or immunogenic fragment are each 8-29 amino acids in length. In some embodiments, the heparanase isoform 1 polypeptide comprises the amino acid sequence of SEQ ID NO: 1 and the heparanase isoform 2 polypeptide comprises the amino acid sequence of SEQ ID NO:2. In some embodiments, the SMAD4 polypeptide comprises the amino acid sequence of SEQ ID NO:3. In some embodiments, the one or more immunogenic fragments consist of about 70%, 75%, 80%, 85%, 90%, 95%, 96%, 97%, 98%, or 99% of the total number of amino acids of SEQ ID NO:6, SEQ ID NO:7, or SEQ ID NO:8. In some embodiments, one or more immunogenic fragments consist of SEQ ID NO:6, SEQ ID NO:7, or SEQ ID NO:8 lacking about 1, 2, 3, 4, 5, 10, 15, 20, 25, 30, 35, 40, 45, 50, or more amino acids. In some embodiments, the heparanase isoform 1 polypeptide comprises an amino acid sequence at least 85%, 90%, 95%, 97%, or 99% identical to SEQ ID NO:6 and wherein the heparanase isoform 1 polypeptide comprises an amino acid sequence at least 85%, 90%, 95%, 97%, or 99% identical to SEQ ID NO:7. In some embodiments, the SMAD4 polypeptide comprises an amino acid sequence at least 85%, 90%, 95%, 97%, or 99% identical to SEQ ID NO:8. In some embodiments, the compositions further comprises an adjuvant.

In another aspect of the invention, methods of treating cancer comprises administering to a subject the immunogenic compositions described herein. In some embodiments, the subject has or is at risk of cancer, and/or exhibits one or more signs or symptoms of cancer, and/or exhibits one or more risk factors for cancer. In some embodiments, the cancer is colorectal cancer, melanoma, or lung cancer.

In another aspect of the invention, methods of inducing an immune response in a subject, comprise administering to a subject the immunogenic compositions described herein. In some embodiment, the immune response comprises activation of one or more lymphocytes. In some embodiments, the one or more lymphocytes comprise CD4+ T cells. In some embodiments, the one or more lymphocytes comprise CD8+ T cells. In some embodiments, the one or more lymphocytes comprise NKT cells, gamma-delta T cells, or NK cells. In some embodiments, the one or more lymphocytes comprise any combination of CD4+ T cells, CD8+ T cells, NKT cells, gamma-delta T cells, and NK cells. In some embodiments, the immune response comprises an increased expression and/or secretion of one or more immune mediators relative to a control. In some embodiments, the lymphocyte signaling molecule is selected from among immune mediators. In some embodiments, the one or more immune mediators are cytokines. In some embodiments, the one or more cytokines are selected from TRAIL, IFN-gamma, IL-12p70, IL-2, TNF-alpha, MIP1-alpha, MIP1-beta, CXCL9, CXCL10, MCP1, RANTES, IL-1 beta, IL-4, IL-6, IL-8, IL-9, IL-10, IL-13, IL-15, CXCL11, IL-3, IL-5, IL-17, IL-18, IL-21, IL-22, IL-23A, IL-24, IL-27, IL-31, IL-32, TGF-beta, CSF, GM-CSF, TRANCE (also known as RANK L), MIP3-alpha, MCP1, and fractalkine. In some embodiments, the one or more immune mediators are soluble mediators. In some embodiments, the one or more soluble mediators are selected from granzyme A, granzyme B, sFas, sFasL, perforin, and granulysin. In some embodiments, the one or more immune mediators are cell surface markers. In some embodiments, the one or more cell surface markers are selected from CD107a, CD107b, CD25, CD69, CD45RA, CD45RO, CD137 (4-1BB), CD44, CD62L, CD27, CCR7, CD154 (CD40L), KLRG-1, CD71, HLA-DR, CD122 (IL-2RB), CD28, IL7Ra (CD127), CD38, CD26, CD134 (OX-40), CTLA-4 (CD152), LAG-3, TIM-3 (CD366), CD39, PD1 (CD279), FoxP3, TIGIT, CD160, BTLA, 2B4 (CD244), and KLRG1. In some embodiments, a level of one or more expressed or secreted immune mediators that is at least 20%, 40%, 60%, 80%, 100%, 120%, 140%, 160%, 180%, or 200% higher than a control level. In some embodiments, a level of one or more expressed or secreted immune mediators that is at least one, two, or three standard deviations higher than the mean of a control level indicates lymphocyte activation. In some embodiments, a level of one or more expressed or secreted immune mediators that is at least 1, 2, 3, 4 or 5 median absolute deviations (MADs) higher or lower than a median response level to a control indicates lymphocyte activation. In some embodiments, the immune response comprises a humoral response and/or a cellular response. In some embodiments, humoral response comprises an increase in magnitude of response or fold rise from baseline of antigen specific immunoglobulin G (IgG) levels and/or of antigen specific neutralizing antibody levels. In some embodiments, the humoral response comprises a 4-fold or greater rise in IgG titer from baseline. In some embodiments, the humoral response comprises a 2-fold or greater rise in 50% neutralizing antibody titer from baseline. In some embodiments, the cellular response comprises secretion of granzyme B (GrB). In some embodiments, the cellular response comprises an increase in magnitude of response or fold rise from baseline of granzyme B (GrB) levels. In some embodiments, the cellular response comprises an increase in IFN-gamma secretion for T cells. In some embodiments, the subject has or is at risk of cancer, and/or exhibits one or more signs or symptoms of cancer, and/or exhibits one or more risk factors for cancer. In some embodiments, the cancer is colorectal cancer, melanoma, or lung cancer.

In another aspect, the disclosure features a method for manufacturing an immunogenic composition, the method comprising combining one or more antigens identified by any method described herein and a carrier.

In some embodiments, the antigen is produced using recombinant DNA technology in a suitable host cell. In some embodiments, the method comprises formulating the immunogenic composition as a pharmaceutical composition.

In another aspect, the disclosure features a method for manufacturing an immunogenic composition for administration to a subject in need thereof, the method comprising:
a. providing, preparing, or obtaining a plurality of antigenic compositions comprising a plurality of antigens, each composition comprising a different antigen; b. providing, preparing, or obtaining a target response profile, wherein the target response profile comprises a representation of the level of expression and/or secretion of one or more immune mediators associated (e.g., determined, measured, observed) with the plurality of antigens; c. providing, preparing, or obtaining a subject response profile, wherein the subject response profile comprises a representation of the level of expression and/or secretion of one or more immune mediators associated (e.g., determined, measured, observed) with the plurality of antigens; d. comparing the target response profile to the subject response profile; e. selecting one or more antigens based on the comparison; and f. formulating at least a portion of one or more antigenic compositions comprising the one or more selected antigens as a pharmaceutical composition.

In some embodiments, the selecting step comprises selecting one or more antigens that increase expression or secretion of immune mediators associated with a beneficial response to cancer, and/or one or more antigens that inhibit and/or suppress expression or secretion of immune mediators associated with deleterious or not beneficial responses to cancer. In some embodiments, the plurality of antigenic compositions are in solution, lyophilized, or on a synthetic matrix.

In another aspect, the disclosure features a method of manufacturing an immunogenic composition for administration to a subject in need thereof, the method comprising: preparing one or more antigens, or fragments thereof, identified by any of the method described herein; combining one or more antigens, or fragments thereof, wherein the one or more antigens or fragments thereof are selected according to the subject's response profile; and formulating the immunogenic composition as a pharmaceutical composition.

In another aspect, the disclosure features a method of manufacturing an immunogenic composition for administration to a subject in need thereof, the method comprising: preparing one or more antigens, or fragments thereof, identified by any method described herein; combining one or more antigens, or fragments thereof, wherein the one or more antigens or fragments thereof are selected according to whether or not the one or more antigens have been shown to stimulate, inhibit and/or suppress and/or have minimal effect on level of expression and/or secretion of one or more immune mediators by the subject's lymphocytes; and formulating the immunogenic composition as a pharmaceutical composition.

In another aspect, the disclosure features a method of manufacturing an immunogenic composition for administration to a subject in need thereof, the method comprising: preparing one or more antigens, or fragments thereof, identified by any method described herein;
combining one or more antigens, or fragments thereof, wherein the one or more antigens or fragments thereof are selected according to the subject's response profile; and formulating the immunogenic composition as a pharmaceutical composition.

BRIEF DESCRIPTION OF THE DRAWINGS

The present teachings described herein will be more fully understood from the following description of various illustrative embodiments, when read together with the accompanying drawings. It should be understood that the drawings described below are for illustration purposes only and are not intended to limit the scope of the present teachings in any way.

FIG. 12A represents epitopes predicted that had binding affinity projected to be below 500 nM for the mutant peptide (neoantigen) but not for its wild-type counterpart, and an IEDB percentile rank of ≤1 for the mutant peptide but not for wild-type. FIG. 12B represents epitopes predicted to have binding affinity below 500 nM or an IEDB percentile rank of ≤1, irrespective of the wild-type counterpart predictions.

FIG. 13A represents epitopes predicted that had binding affinity projected to be below 500 nM for the mutant peptide (neoantigen) but not for its wild-type counterpart, and an IEDB percentile rank of ≤1 for the mutant peptide but not for wild-type. FIG. 13B represents epitopes predicted to have binding affinity below 500 nM or an IEDB percentile rank of ≤1, irrespective of the wild-type counterpart predictions.

FIGS. 15A and 15B are graphs showing the high frequency of T cell stimulatory responses to three novel ATLAS-identified TAAs in comparison to three TAAs that are or were in clinical development as a therapeutic vaccine.

FIGS. 23A and 23C show the total numbers and overlap of neoantigens predicted by algorithm and observed in ATLAS. FIGS. 23B and 23D show the break-down of predictions by strong binding (<150 nM), weak binding (<500 nM), or non-binding (>=500 nM). There is no enrichment of either stimulatory or inhibitory and/or suppressive responses in CD8+ T cells across binding prediction groups.

DEFINITIONS

Figure 1:
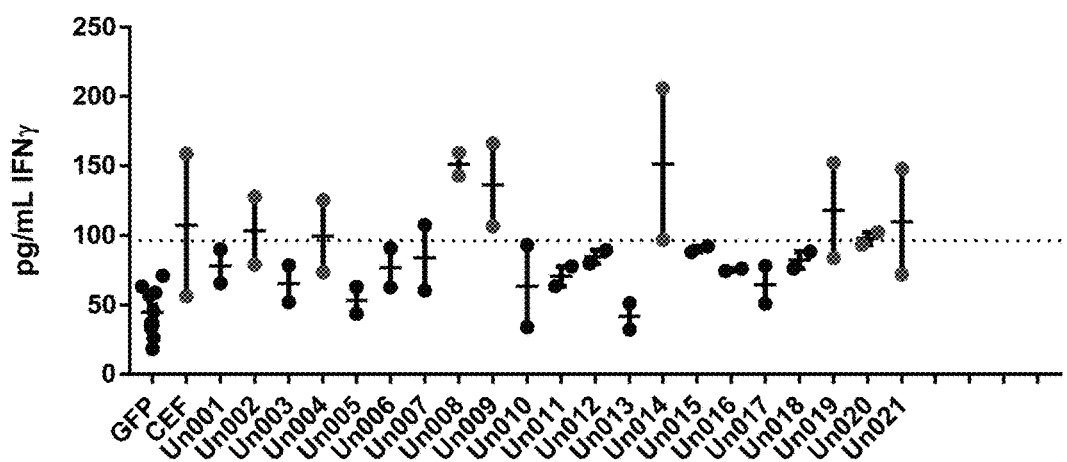
FIG. 1 is a graph showing IFNγ secreted in supernatants by T cells from a representative melanoma patient who received immune checkpoint blockade therapy. The T cells were co-cultured with autologous antigen presenting cells pulsed with *E. coli* expressing various tumor-associated antigens.

Activate: As used herein, a peptide presented by an antigen presenting cell (APC) "activates" a lymphocyte if lymphocyte activity is detectably modulated after exposure to the peptide presented by the APC under conditions that permit antigen-specific recognition to occur. Any indicator of lymphocyte activity can be evaluated to determine whether a lymphocyte is activated, e.g., T cell proliferation, phosphorylation or dephosphorylation of a receptor, calcium flux, cytoskeletal rearrangement, increased or decreased expression and/or secretion of immune mediators such as cytokines or soluble mediators, increased or decreased expression of one or more cell surface markers.

Administration: As used herein, the term "administration" typically refers to the administration of a composition to a subject or system. Those of ordinary skill in the art will be aware of a variety of routes that may, in appropriate circumstances, be utilized for administration to a subject, for example a human. For example, in some embodiments, administration may be systemic or local. In some embodiments, administration may be enteral or parenteral. In some embodiments, administration may be by injection (e.g., intramuscular, intravenous, or subcutaneous injection). In some embodiments, injection may involve bolus injection, drip, perfusion, or infusion. In some embodiments administration may be topical. Those skilled in the art will be aware of appropriate administration routes for use with particular therapies described herein, for example from among those listed on www.fda.gov, which include auricular (otic), buccal, conjunctival, cutaneous, dental, endocervical, endosinusial, endotracheal, enteral, epidural, extra-amniotic, extracorporeal, interstitial, intra-abdominal, intra-amniotic, intra-arterial, intra-articular, intrabiliary, intrabronchial, intrabursal, intracardiac, intracartilaginous, intracaudal, intracavernous, intracavitary, intracerebral, intracisternal, intracorneal, intracoronal, intracorporus cavernosum, intradermal, intranodal, intradiscal, intraductal, intraduodenal, intradural, intraepidermal, intraesophageal, intragastic, intragingival, intralesional, intraluminal, intralymphatic, intramedullary, intrameningeal, intramuscular, intraocular, intraovarian, intrapericardial, intraperitoneal, intrapleural, intraprostatic, intrapulmonary, intrasinal, intraspinal, intrasynovial, intratendinous, intratesticular, intrathecal, intrathoracic, intratubular, intratumor, intratympanic, intrauterine, intravascular, intravenous, intravenous bolus, intravenous drip, intraventricular, intravitreal, laryngeal, nasal, nasogastric, ophthalmic, oral, oropharyngeal, parenteral, percutaneous, periarticular, peridural, perineural, periodontal, rectal, respiratory (e.g., inhalation), retrobulbar, soft tissue, subarachnoid, subconjunctival, subcutaneous, sublingual, submucosal, topical, transdermal, transmucosal, transplacental, transtracheal, ureteral, urethral, or vaginal. In some embodiments, administration may involve electro-osmosis, hemodialysis, infiltration, iontophoresis, irrigation, and/or occlusive dressing. In some embodiments, administration may involve dosing that is intermittent (e.g., a plurality of doses separated in time) and/or periodic (e.g., individual doses separated by a common period of time) dosing. In some embodiments, administration may involve continuous dosing.

Antigen: The term "antigen", as used herein, refers to a molecule (e.g., a polypeptide) that elicits a specific immune response. Antigen-specific immunological responses, also known as adaptive immune responses, are mediated by lymphocytes (e.g., T cells, B cells, NK cells) that express antigen receptors (e.g., T cell receptors, B cell receptors). In certain embodiments, an antigen is a T cell antigen, and elicits a cellular immune response. In certain embodiments, an antigen is a B cell antigen, and elicits a humoral (i.e., antibody) response. In certain embodiments, an antigen is both a T cell antigen and a B cell antigen. As used herein, the term "antigen" encompasses both a full-length polypeptide as well as a portion or immunogenic fragment of the polypeptide, and a peptide epitope within the polypeptides (e.g., a peptide epitope bound by a Major Histocompatibility Complex (MHC) molecule (e.g., MHC class I, or MHC class II)).

Antigen presenting cell: An "antigen presenting cell" or "APC" refers to a cell that presents peptides on MHC class I and/or MHC class II molecules for recognition by T cells. APC include both professional APC (e.g., dendritic cells, macrophages, B cells), which have the ability to stimulate naïve lymphocytes, and non-professional APC (e.g., fibroblasts, epithelial cells, endothelial cells, glial cells). In certain embodiments, APC are able to internalize (e.g., endocytose) members of a library (e.g., cells of a library of bacterial cells) that express heterologous polypeptides as candidate antigens.

Autolysin polypeptide: An "autolysin polypeptide" is a polypeptide that facilitates or mediates autolysis of a cell (e.g., a bacterial cell) that has been internalized by a eukaryotic cell. In some embodiments, an autolysin polypeptide is a bacterial autolysin polypeptide. Autolysin polypeptides include, and are not limited to, polypeptides whose sequences are disclosed in GenBank® under Acc. Nos. NP_388823.1, NP_266427.1, and P0AGC3.1.

Cancer: As used herein, the term "cancer" refers to a disease, disorder, or condition in which cells exhibit relatively abnormal, uncontrolled, and/or autonomous growth, so that they display an abnormally elevated proliferation rate and/or aberrant growth phenotype characterized by a significant loss of control of cell proliferation. In some embodiments, a cancer may be characterized by one or more tumors. Those skilled in the art are aware of a variety of types of cancer including, for example, adrenocortical carcinoma, astrocytoma, basal cell carcinoma, carcinoid, cardiac, cholangiocarcinoma, chordoma, chronic myeloproliferative neoplasms, craniopharyngioma, ductal carcinoma in situ, ependymoma, intraocular melanoma, gastrointestinal carcinoid tumor, gastrointestinal stromal tumor (GIST), gestational trophoblastic disease, glioma, histiocytosis, leukemia (e.g., acute lymphoblastic leukemia (ALL), acute myeloid leukemia (AML), chronic lymphocytic leukemia (CLL), chronic myelogenous leukemia (CML), hairy cell leukemia, myelogenous leukemia, myeloid leukemia), lymphoma (e.g., Burkitt lymphoma [non-Hodgkin lymphoma], cutaneous T cell lymphoma, Hodgkin lymphoma, mycosis fungoides, Sezary syndrome, AIDS-related lymphoma, follicular lymphoma, diffuse large B-cell lymphoma), melanoma, merkel cell carcinoma, mesothelioma, myeloma (e.g., multiple myeloma), myelodysplastic syndrome, papillomatosis, paraganglioma, pheochromacytoma, pleuropulmonary blastoma, retinoblastoma, sarcoma (e.g., Ewing sarcoma, Kaposi sarcoma, osteosarcoma, rhabdomyosarcoma, uterine sarcoma, vascular sarcoma), Wilms' tumor, and/or cancer of the adrenal cortex, anus, appendix, bile duct, bladder, bone, brain, breast, bronchus, central nervous system, cervix, colon, endometrium, esophagus, eye, fallopian tube, gall bladder, gastrointestinal tract, germ cell, head and neck, heart, intestine, kidney (e.g., Wilms' tumor), larynx, liver, lung (e.g., non-small cell lung cancer, small cell lung cancer), mouth, nasal cavity, oral cavity, ovary, pancreas, rectum, skin, stomach, testes, throat, thyroid, penis, pharynx, peritoneum, pituitary, prostate, rectum, salivary gland, ureter, urethra, uterus, vagina, or vulva.

Cytolysin polypeptide: A "cytolysin polypeptide" is a polypeptide that has the ability to form pores in a membrane of a eukaryotic cell. A cytolysin polypeptide, when expressed in host cell (e.g., a bacterial cell) that has been internalized by a eukaryotic cell, facilitates release of host cell components (e.g., host cell macromolecules, such as host cell polypeptides) into the cytosol of the internalizing cell. In some embodiments, a cytolysin polypeptide is bacterial cytolysin polypeptide. In some embodiments, a cytolysin polypeptide is a cytoplasmic cytolysin polypeptide. Cytolysin polypeptides include, and are not limited to, polypeptides whose sequences are disclosed in U.S. Pat. No. 6,004,815, and in GenBank® under Acc. Nos. NP_463733.1, NP_979614, NP_834769, YP_084586, YP_895748, YP_694620, YP_012823, NP_346351, YP_597752, BAB41212.2, NP_561079.1, YP_001198769, and NP_359331.1.

Cytoplasmic cytolysin polypeptide: A "cytoplasmic cytolysin polypeptide" is a cytolysin polypeptide that has the ability to form pores in a membrane of a eukaryotic cell, and that is expressed as a cytoplasmic polypeptide in a bacterial cell. A cytoplasmic cytolysin polypeptide is not significantly secreted by a bacterial cell. Cytoplasmic cytolysin polypeptides can be provided by a variety of means. In some embodiments, a cytoplasmic cytolysin polypeptide is provided as a nucleic acid encoding the cytoplasmic cytolysin polypeptide. In some embodiments, a cytoplasmic cytolysin polypeptide is provided attached to a bead. In some embodiments, a cytoplasmic cytolysin polypeptide has a sequence that is altered relative to the sequence of a secreted cytolysin polypeptide (e.g., altered by deletion or alteration of a signal sequence to render it nonfunctional). In some embodiments, a cytoplasmic cytolysin polypeptide is cytoplasmic because it is expressed in a secretion-incompetent cell. In some embodiments, a cytoplasmic cytolysin polypeptide is cytoplasmic because it is expressed in a cell that does not recognize and mediate secretion of a signal sequence linked to the cytolysin polypeptide. In some embodiments, a cytoplasmic cytolysin polypeptide is a bacterial cytolysin polypeptide.

Heterologous: The term "heterologous", as used herein to refer to genes or polypeptides, refers to a gene or polypeptide that does not naturally occur in the organism in which it is present and/or being expressed, and/or that has been introduced into the organism by the hand of man. In some embodiments, a heterologous polypeptide is a tumor antigen described herein.

Immune mediator: As used herein, the term "immune mediator" refers to any molecule that affects the cells and processes involved in immune responses. Immune mediators include cytokines, chemokines, soluble proteins, and cell surface markers.

Improve, increase, inhibit, stimulate, suppress, or reduce: As used herein, the terms "improve", "increase", "inhibit", "stimulate", "suppress", "reduce", or grammatical equivalents thereof, indicate values that are relative to a baseline or other reference measurement. In some embodiments, an appropriate reference measurement may be or comprise a measurement in a particular system (e.g., in a single individual) under otherwise comparable conditions absent presence of (e.g., prior to and/or after) a particular agent or treatment, or in presence of an appropriate comparable reference agent. The effect of a particular agent or treatment may be direct or indirect. In some embodiments, an appropriate reference measurement may be or may comprise a measurement in a comparable system known or expected to respond in a particular way, in presence of the relevant agent or treatment. In some embodiments, a peptide presented by an antigen presenting cell (APC) "stimulates" or is "stimulatory" to a lymphocyte if the lymphocyte is activated to a phenotype associated with beneficial responses, after exposure to the peptide presented by the APC under conditions that permit antigen-specific recognition to occur, as observed by, e.g., T cell proliferation, phosphorylation or dephosphorylation of a receptor, calcium flux, cytoskeletal rearrangement, increased or decreased expression and/or secretion of immune mediators such as cytokines or soluble mediators, increased or decreased expression of one or more cell surface markers, relative to a control. In some embodiments, a peptide presented by an antigen presenting cell "suppresses", "inhibits" or is "inhibitory" to a lymphocyte if the lymphocyte is activated to a phenotype associated with deleterious or non-beneficial responses, after exposure to the peptide presented by the APC under conditions that permit antigen-specific recognition to occur, as observed by, e.g., phosphorylation or dephosphorylation of a receptor, calcium flux, cytoskeletal rearrangement, increased or decreased expression and/or secretion of immune mediators such as cytokines or soluble mediators, increased or decreased expression of one or more cell surface markers, relative to a control.

Invasin polypeptide: An "invasin polypeptide" is a polypeptide that facilitates or mediates uptake of a cell (e.g., a bacterial cell) by a eukaryotic cell. Expression of an invasin polypeptide in a noninvasive bacterial cell confers on the cell the ability to enter a eukaryotic cell. In some embodiments, an invasin polypeptide is a bacterial invasin polypeptide. In some embodiments, an invasin polypeptide is a *Yersinia* invasin polypeptide (e.g., a *Yersinia* invasin polypeptide comprising a sequence disclosed in GenBank® under Acc. No. YP_070195.1).

Listeriolysin O (LLO): The terms "listeriolysin O" or "LLO" refer to a listeriolysin O polypeptide of *Listeria monocytogenes* and truncated forms thereof that retain pore-forming ability (e.g., cytoplasmic forms of LLO, including truncated forms lacking a signal sequence). In some embodiments, an LLO is a cytoplasmic LLO. Exemplary LLO sequences are shown in Table 1, below.

Polypeptide: The term "polypeptide", as used herein, generally has its art-recognized meaning of a polymer of at least three amino acids. Those of ordinary skill in the art will appreciate, however, that the term "polypeptide" is intended to be sufficiently general as to encompass not only polypeptides having the complete sequence recited herein (or in a reference or database specifically mentioned herein), but also to encompass polypeptides that represent functional fragments (i.e., fragments retaining at least one activity) and immunogenic fragments of such complete polypeptides. Moreover, those of ordinary skill in the art understand that protein sequences generally tolerate some substitution without destroying activity. Thus, any polypeptide that retains activity and shares at least about 30-40% overall sequence identity, often greater than about 50%, 60%, 70%, or 80%, and further usually including at least one region of much higher identity, often greater than 90% or even 95%, 96%, 97%, 98%, or 99% in one or more highly conserved regions, usually encompassing at least 3-4 and often up to 20 or more amino acids, with another polypeptide of the same class, is encompassed within the relevant term "polypeptide" as used herein. Other regions of similarity and/or identity can be determined by those of ordinary skill in the art by analysis of the sequences of various polypeptides.

Primary cells: As used herein, "primary cells" refers to cells from an organism that have not been immortalized in vitro. In some embodiments, primary cells are cells taken directly from a subject (e.g., a human). In some embodiments, primary cells are progeny of cells taken from a subject (e.g., cells that have been passaged in vitro). Primary cells include cells that have been stimulated to proliferate in culture.

Response: As used herein, in the context of a subject (a patient or experimental organism), "response", "responsive", or "responsiveness" refers to an alteration in a subject's condition that occurs as a result of, or correlates with, treatment. In certain embodiments, a response is a beneficial response. In certain embodiments, a beneficial response can include stabilization of a subject's condition (e.g., prevention or delay of deterioration expected or typically observed to occur absent the treatment), amelioration (e.g., reduction in frequency and/or intensity) of one or more symptoms of the condition, and/or improvement in the prospects for cure of the condition, etc. In certain embodiments, for a subject who has cancer, a beneficial response can include: the subject has a positive clinical response to cancer therapy or a combination of therapies; the subject has a spontaneous response to a cancer; the subject is in partial or complete remission from cancer; the subject has cleared a cancer; the subject has not had a relapse, recurrence or metastasis of a cancer; the subject has a positive cancer prognosis; the subject has not experienced toxic responses or side effects to a cancer therapy or combination of therapies. In certain embodiments, for a subject who had cancer, the beneficial responses occurred in the past, or are ongoing.

In certain embodiments, a response is a deleterious or non-beneficial response. In certain embodiments, a deleterious or non-beneficial response can include deterioration of a subject's condition, lack of amelioration (e.g., no reduction in frequency and/or intensity) of one or more symptoms of the condition, and/or degradation in the prospects for cure of the condition, etc. In certain embodiments, for a subject who has cancer, a deleterious or non-beneficial response can include: the subject has a negative clinical response to cancer therapy or a combination of therapies; the subject is not in remission from cancer; the subject has not cleared a cancer; the subject has had a relapse, recurrence or metastasis of a cancer; the subject has a negative cancer prognosis; the subject has experienced toxic responses or side effects to a cancer therapy or combination of therapies. In certain embodiments, for a subject who had cancer, the deleterious or non-beneficial responses occurred in the past, or are ongoing.

As used herein, in the context of a cell, organ, tissue, or cell component, e.g., a lymphocyte, "response", "responsive", or "responsiveness" refers to an alteration in cellular activity that occurs as a result of, or correlates with, administration of or exposure to an agent, e.g. a tumor antigen. In certain embodiments, a beneficial response can include increased expression and/or secretion of immune mediators associated with positive clinical responses or outcomes in a subject. In certain embodiments, a beneficial response can include decreased expression and/or secretion of immune mediators associated with negative clinical response or outcomes in a subject. In certain embodiments, a deleterious or non-beneficial response can include increased expression and/or secretion of immune mediators associated with negative clinical responses or outcomes in a subject. In certain embodiments, a deleterious or non-beneficial response can include decreased expression and/or secretion of immune mediators associated with positive clinical responses or outcomes in a subject. In certain embodiments, a response is a clinical response. In certain embodiments, a response is a cellular response. In certain embodiments, a response is a direct response. In certain embodiments, a response is an indirect response. In certain embodiments, "non-response", "non-responsive", or "non-responsiveness" mean minimal response or no detectable response. In certain embodiments, a "minimal response" includes no detectable response. In certain embodiments, presence, extent, and/or nature of response can be measured and/or characterized according to particular criteria. In certain embodiments, such criteria can include clinical criteria and/or objective criteria. In certain embodiments, techniques for assessing response can include, but are not limited to, clinical examination, positron emission tomography, chest X-ray, CT scan, MRI, ultrasound, endoscopy, laparoscopy, presence or level of a particular marker in a sample, cytology, and/or histology. Where a response of interest is a response of a tumor to a therapy, ones skilled in the art will be aware of a variety of established techniques for assessing such response, including, for example, for determining tumor burden, tumor size, tumor stage, etc. Methods and guidelines for assessing response to treatment are discussed in Therasse et al., J. Natl. Cancer Inst., 2000, 92(3):205-216; and Seymour et al., Lancet Oncol., 2017, 18:e143-52. The exact response criteria can be selected in any appropriate manner, provided that when comparing groups of tumors, patients or experimental organism, and/or cells, organs, tissues, or cell components, the groups to be compared are assessed based on the same or comparable criteria for determining response rate. One of ordinary skill in the art will be able to select appropriate criteria.

Tumor: As used herein, the term "tumor" refers to an abnormal growth of cells or tissue. In some embodiments, a tumor may comprise cells that are precancerous (e.g., benign), malignant, pre-metastatic, metastatic, and/or non-metastatic. In some embodiments, a tumor is associated with, or is a manifestation of, a cancer. In some embodiments, a tumor may be a disperse tumor or a liquid tumor. In some embodiments, a tumor may be a solid tumor.

DETAILED DESCRIPTION

Recent advances in immune checkpoint inhibitor therapies such as ipilimumab, nivolumab, and pembrolizumab for cancer immunotherapy have resulted in dramatic efficacy in subjects suffering from NSCLC, among other indications. Nivolumab and pembroluzimab have been approved by the Food and Drug Administration (FDA) and European Medicines Agency (EMA) for use in patients with advanced NSCLC who have previously been treated with chemotherapy. They have solidified the importance of T cell responses in control of tumors. Neoantigens, potential cancer rejection antigens that are entirely absent from the normal human genome, are postulated to be relevant to tumor control; however, attempts to define them and their role in tumor clearance has been hindered by the paucity of available tools to define them in a biologically relevant and unbiased way (Schumacher and Schreiber, 2015 *Science* 348:69-74, Gilchuk et al., 2015 *Curr Opin Immunol* 34:43-51)

Taking non-small cell lung carcinoma (NSCLC) as an example, whole exome sequencing of NSCLC tumors from patients treated with pembrolizumab showed that higher non-synonymous mutation burden in tumors was associated with improved objective response, durable clinical benefit, and progression-free survival (Rizvi et al., (2015) *Science* 348(6230): 124-8). In this study, the median non-synonymous mutational burden of the discovery cohort was 209 and of the validation cohort was 200. However, simply because a mutation was identified by sequencing, does not mean that the epitope it creates can be recognized by a T cell or serves as a protective antigen for T cell responses (Gilchuk et al., 2015 *Curr Opin Immunol* 34:43-51), making the use of the word neoantigen somewhat of a misnomer. With 200 or more potential targets of T cells in NSCLC, it is not feasible to test every predicted epitope to determine which of the mutations serve as neoantigens, and which neoantigens are associated with clinical evidence of tumor control. Recently, a study by McGranahan et al., showed that clonal neoantigen burden and overall survival in primary lung adenocarcinomas are related. However, even enriching for clonal neoantigens results in potential antigen targets ranging from 50 to approximately 400 (McGranahan et al., 2016 *Science* 351:1463-69). Similar findings have been described for melanoma patients who have responded to ipilimumab therapy (Snyder et al., 2015 NEJM; Van Allen et al., 2015 Science) and in patients with mismatch-repair deficient colorectal cancer who were treated with pembrolizumab (Le et al., 2015 NEJM).

The present disclosure provides methods and systems for the rapid identification of tumor antigens (e.g., tumor specific antigens (TSAs, or neoantigens), tumor associated antigens (TAAs), or cancer/testis antigens (CTAs)) that elicit T cell responses and particularly that elicit human T cell responses, as well as polypeptides that are potential tumor antigens. For purposes of this disclosure, "tumor antigens" includes both tumor antigens and potential tumor antigens. As described herein, methods of the present disclosure identified stimulatory tumor antigens that were not identified by known algorithms. Further, methods of the present disclosure identified suppressive and/or inhibitory tumor antigens that are not identifiable by known algorithms. Methods of the present disclosure also identified polypeptides that are potential tumor antigens, i.e., polypeptides that activate T cells of non-cancerous subjects, but not T cells of subjects suffering from cancer. The present disclosure also provides methods of selecting tumor antigens and potential tumor antigens, methods of using the selected tumor antigens and potential tumor antigens, immunogenic compositions comprising the selected tumor antigens and potential tumor antigens, and methods of manufacturing immunogenic compositions. The present disclosure also provides methods of evaluating an immune response in a cancer subject, e.g., for identifying or selecting subjects for initiation, continuation, modification, and/or discontinuation of cancer therapy.

Library Generation

A library is a collection of members (e.g., cells or non-cellular particles, such as virus particles, liposomes, or beads (e.g., beads coated with polypeptides, such as in vitro translated polypeptides, e.g., affinity beads, e.g., antibody coated beads, or NTA-Ni beads bound to polypeptides of interest). According to the present disclosure, members of a library include (e.g., internally express or carry) polypeptides of interest described herein. In some embodiments, members of a library are cells that internally express polypeptides of interest described herein. In some embodiments, members of a library which are particles carry, and/or are bound to, polypeptides of interest. Use of a library in an assay system allows simultaneous evaluation in vitro of cellular responses to multiple candidate antigens. According to the present disclosure, a library is designed to be internalized by human antigen presenting cells so that peptides from library members, including peptides from internally expressed polypeptides of interest, are presented on MHC molecules of the antigen presenting cells for recognition by T cells.

Libraries can be used in assays that detect peptides presented by human MHC class I and MHC class II molecules. Polypeptides expressed by the internalized library members are digested in intracellular endocytic compartments (e.g., phagosomes, endosomes, lysosomes) of the human cells and presented on MHC class II molecules, which are recognized by human $CD4^+$ T cells. In some embodiments, library members include a cytolysin polypeptide, in addition to a polypeptide of interest. In some embodiments, library members include an invasin polypeptide, in addition to the polypeptide of interest. In some embodiments, library members include an autolysin polypeptide, in addition to the polypeptide of interest. In some embodiments, library members are provided with cells that express a cytolysin polypeptide (i.e., the cytolysin and polypeptide of interest are not expressed in the same cell, and an antigen presenting cell is exposed to members that include the cytolysin and members that include the polypeptide of interest, such that the antigen presenting cell internalizes both, and such that the cytolysin facilitates delivery of polypeptides of interest to the MHC class I pathway of the antigen presenting cell). A cytolysin polypeptide can be constitutively expressed in a cell, or it can be under the control of an inducible expression system (e.g., an inducible promoter). In some embodiments, a cytolysin is expressed under the control of an inducible promoter to minimize cytotoxicity to the cell that expresses the cytolysin.

Once internalized by a human cell, a cytolysin polypeptide perforates intracellular compartments in the human cell, allowing polypeptides expressed by the library members to gain access to the cytosol of the human cell. Polypeptides released into the cytosol are presented on MHC class I molecules, which are recognized by $CD8^+$ T cells.

A library can include any type of cell or particle that can be internalized by and deliver a polypeptide of interest (and a cytolysin polypeptide, in applications where a cytolysin polypeptide is desirable) to, antigen presenting cells for use in methods described herein. Although the term "cell" is used throughout the present specification to refer to a library member, it is understood that, in some embodiments, the library member is a non-cellular particle, such as a virus particle, liposome, or bead. In some embodiments, members of the library include polynucleotides that encode the polypeptide of interest (and cytolysin polypeptide), and can be induced to express the polypeptide of interest (and cytolysin polypeptide) prior to, and/or during internalization by antigen presenting cells.

In some embodiments, the cytolysin polypeptide is heterologous to the library cell in which it is expressed, and facilitates delivery of polypeptides expressed by the library cell into the cytosol of a human cell that has internalized the library cell. Cytolysin polypeptides include bacterial cytolysin polypeptides, such as listeriolysin O (LLO), streptolysin O (SLO), and perfringolysin O (PFO). Additional cytolysin polypeptides are described in U.S. Pat. No. 6,004,815. In certain embodiments, library members express LLO. In some embodiments, a cytolysin polypeptide is not significantly secreted by the library cell (e.g., less than 20%, 10%, 5%, or 1% of the cytolysin polypeptide produced by the cell is secreted). For example, the cytolysin polypeptide is a cytoplasmic cytolysin polypeptide, such as a cytoplasmic LLO polypeptide (e.g., a form of LLO which lacks the N-terminal signal sequence, as described in Higgins et al., Mol. Microbiol. 31(6):1631-1641, 1999). Exemplary cytolysin polypeptide sequences are shown in Table 1. The listeriolysin O (Δ3-25) sequence shown in the second row of Table 1 has a deletion of residues 3-25, relative to the LLO sequence in shown in the first row of Table 1, and is a cytoplasmic LLO polypeptide. In some embodiments, a cytolysin is expressed constitutively in a library host cell. In other embodiments, a cytolysin is expressed under the control of an inducible promoter. Cytolysin polypeptides can be expressed from the same vector, or from a different vector, as the polypeptide of interest in a library cell.

TABLE 1

Exemplary Cytolysin Polypeptides

| Polypeptide Name (species) | Polypeptide Accession No. GI No. | Polypeptide Sequence |
| --- | --- | --- |
| listeriolysin O (*Listeria monocytogenes*) | NP_463733.1 GI:16802248 | MKKIMLVFITLILVSLPIAQQTEAKDASAFNKENSISSMAPPASP PASPKTPIEKKHADEIDKYIQGLDYNKNNVLVYHGDAVTNVPPRK GYKDGNEYIVVEKKKKSINQNNADIQVVNAISSLTYPGALVKANS ELVENQPDVLPVKRDSLTLSIDLPGMTNQDNKIVVKNATKSNVNN AVNTLVERWNEKYAQAYPNVSAKIDYDDEMAYSESQLIAKFGTAF KAVNNSLNVNFGAISEGKMQEEVISFKQIYYNVNVNEPTRPSRFF GKAVTKEQLQALGVNAENPPAYISSVAYGRQVYLKLSTNSHSTKV KAAFDAAVSGKSVSGDVELTNIIKNSSFKAVIYGGSAKDEVQIID GNLGDLRDILKKGATFNRETPGVPIAYTTNFLKDNELAVIKNNSE YIETTSKAYTDGKINIDHSGGYVAQFNISWDEVNYDPEGNEIVQH KNWSENNKSKLAHFTSSIYLPGNARNINVYAKECTGLAWEWWRTV IDDRNLPLVKNRNISIWGTTLYPKYSNKVDNPIE (SEQ ID NO: 1) |
| listeriolysin O (Δ3-25) | | MKDASAFNKENSISSMAPPASPPASPKTPIEKKHADEIDKYIQGL DYNKNNVLVYHGDAVTNVPPRKGYKDGNEYIVVEKKKKSINQNNA DIQVVNAISSLTYPGALVKANSELVENQPDVLPVKRDSLTLSIDL PGMTNQDNKIVVKNATKSNVNNAVNTLVERWNEKYAQAYPNVSAK IDYDDEMAYSESQLIAKFGTAFKAVNNSLNVNFGAISEGKMQEEV ISFKQIYYNVNVNEPTRPSRFFGKAVTKEQLQALGVNAENPPAYI SSVAYGRQVYLKLSTNSHSTKVKAAFDAAVSGKSVSGDVELTNII KNSSFKAVIYGGSAKDEVQIIDGNLGDLRDILKKGATFNRETPGV PIAYTTNFLKDNELAVIKNNSEYIETTSKAYTDGKINIDHSGGYV AQFNISWDEVNYDPEGNEIVQHKNWSENNKSKLAHFTSSIYLPGN ARNINVYAKECTGLAWEWWRTVIDDRNLPLVKNRNISIWGTTLYP KYSNKVDNPIE (SEQ ID NO: 2) |
| streptolysin O (*Streptococcus pyogenes*) | BAB41212.2 GI:71061060 | MSNKKTFKKYSRVAGLLTAALIIGNLVTANAESNKQNTASTETTT TSEQPKPESSELTIEKAGQKMDDMLNSNDMIKLAPKEMPLESAEK EEKKSEDKKKSEEDHTEEINDKIYSLNYNELEVLAKNGETIENFV PKEGVKKADKFIVIERKKKNINTTPVDISIIDSVTDRTYPAALQL ANKGFTENKPDAVVTKRNPQKIHIDLPGMGDKATVEVNDPTYANV STAIDNLVNQWHDNYSGGNTLPARTQYTESMVYSKSQIEAALNVN SKILDGTLGIDFKSISKGEKKVMIAAYKQIFYTVSANLPNNPADV FDKSVTFKDLQRKGVSNEAPPLFVSNVAYGRTVFVKLETSSKSND VEAAFSAALKGTDVKTNGKYSDILENSSFTAVVLGGDAAEHNKVV TKDFDVIRNVIKDNATFSRKNPAYPISYTSVFLKNNKIAGVNNRT EYVETTSTEYTSGKINLSHQGAYVAQYEILWDEINYDDKGKEVIT KRRWDNNWYSKTSPFSTVIPLGANSRNIRIMARECTGLAWEWWRK VIDERDVKLSKEINVNISGSTLSPYGSITYK (SEQ ID NO: 3) |
| perfringolysin O (*Clostridium perfringens*) | NP_561079.1 GI:18309145 | MIRFKKTKLIASIAMALCLFSQPVISFSKDITDKNQSIDSGISSL SYNRNEVLASNGDKIESFVPKEGKKTGNKFIVVERQKRSLTTSPV DISIIDSVNDRTYPGALQLADKAFVENRPTILMVKRKPININIDL PGLKGENSIKVDDPTYGKVSGAIDELVSKWNEKYSSTHTLPARTQ YSESMVYSKSQISSALNVNAKVLENSLGVDFNAVANNEKKVMILA YKQIFYTVSADLPKNPSDLFDDSVTFNDLKQKGVSNEAPPLMVSN VAYGRTIYVKLETTSSSKDVQAAFKALIKNTDIKNSQQYKDIYEN SSFTAVVLGGDAQEHNKVVTKDFDEIRKVIKDNATFSTKNPAYPI SYTSVFLKDNSVAAVHNKTDYIETTSTEYSKGKINLDHSGAYVAQ FEVAWDEVSYDKEGNEVLTHKTWDGNYQDKTAHYSTVIPLEANAR NIRIKARECTGLAWEWWRDVISEYDVPLTNNINVSIWGTTLYPGS SITYN (SEQ ID NO: 4) |

TABLE 1-continued

Exemplary Cytolysin Polypeptides

| Polypeptide Name (species) | Polypeptide Accession No. GI No. | Polypeptide Sequence |
|---|---|---|
| Pneumolysin (*Streptococcus pneumoniae*) | NP_359331.1 GI:933687 | MANKAVNDFILAMNYDKKKLLTHQGESIENRFIKEGNQLPDEFVV IERKKRSLSTNTSDISVTATNDSRLYPGALLVVDETLLENNPTLL AVDRAPMTYSIDLPGLASSDSFLQVEDPSNSSVRGAVNDLLAKWH QDYGQVNNVPARMQYEKITAHSMEQLKVKFGSDFEKTGNSLDIDF NSVHSGEKQIQIVNFKQIYYTVSVDAVKNPGDVFQDTVTVEDLKQ RGISAERPLVYISSVAYGRQVYLKLETTSKSDEVEAAFEALIKGV KVAPQTEWKQILDNTEVKAVILGGDPSSGARVVTGKVDMVEDLIQ EGSRFTADHPGLPISYTTSFLRDNVVATFQNSTDYVETKVTAYRN GDLLLDHSGAYVAQYYITWDELSYDHQGKEVLTPKAWDRNGQDLT AHFTTSIPLKGNVRNLSVKIRECTGLAWEWWRTVYEKTDLPLVRK RTISIWGTTLYPQVEDKVEND (SEQ ID NO: 5) |

In some embodiments, a library member (e.g., a library member which is a bacterial cell) includes an invasin that facilitates uptake by the antigen presenting cell. In some embodiments, a library member includes an autolysin that facilitates autolysis of the library member within the antigen presenting cell. In some embodiments, a library member includes both an invasin and an autolysin. In some embodiments, a library member which is an *E. coli* cell includes an invasin and/or an autolysin. In various embodiments, library cells that express an invasin and/or autolysin are used in methods that also employ non-professional antigen presenting cells or antigen presenting cells that are from cell lines. Isberg et al. (*Cell*, 1987, 50:769-778), Sizemore et al. (*Science*, 1995, 270:299-302) and Courvalin et al. (*C.R. Acad. Sci. Paris*, 1995, 318:1207-12) describe expression of an invasin to effect endocytosis of bacteria by target cells. Autolysins are described by Cao et al., *Infect. Immun.* 1998, 66(6): 2984-2986; Margot et al., *J. Bacteriol.* 1998, 180(3): 749-752; Buist et al., *Appl. Environ. Microbiol.*, 1997, 63(7):2722-2728; Yamanaka et al., *FEMS Microbiol. Lett.*, 1997, 150(2): 269-275; Romero et al., *FEMS Microbiol. Lett.*, 1993, 108(1):87-92; Betzner and Keck, *Mol. Gen. Genet.*, 1989, 219(3): 489-491; Lubitz et al., *J. Bacteriol.*, 1984, 159(1):385-387; and Tomasz et al., *J. Bacteriol.*, 1988, 170(12): 5931-5934. In some embodiments, an autolysin has a feature that permits delayed lysis, e.g., the autolysin is temperature-sensitive or time-sensitive (see, e.g., Chang et al., 1995, *J. Bact.* 177, 3283-3294; Raab et al., 1985, *J. Mol. Biol.* 19, 95-105; Gerds et al., 1995, *Mol. Microbiol.* 17, 205-210). Useful cytolysins also include addiction (poison/antidote) autolysins, (see, e.g., Magnuson R, et al., 1996, *J. Biol. Chem.* 271(31), 18705-18710; Smith A S, et al., 1997, *Mol. Microbiol.* 26(5), 961-970).

In some embodiments, members of the library include bacterial cells. In certain embodiments, the library includes non-pathogenic, non-virulent bacterial cells. Examples of bacteria for use as library members include *E. coli*, mycobacteria, *Listeria monocytogenes*, *Shigella flexneri*, *Bacillus subtilis*, or *Salmonella*.

In some embodiments, members of the library include eukaryotic cells (e.g., yeast cells). In some embodiments, members of the library include viruses (e.g., bacteriophages). In some embodiments, members of the library include liposomes. Methods for preparing liposomes that include a cytolysin and other agents are described in Kyung-Dall et al., U.S. Pat. No. 5,643,599. In some embodiments, members of the library include beads. Methods for preparing libraries comprised of beads are described, e.g., in Lam et al., *Nature* 354: 82-84, 1991, U.S. Pat. Nos. 5,510,240 and 7,262,269, and references cited therein.

In certain embodiments, a library is constructed by cloning polynucleotides encoding polypeptides of interest, or portions thereof, into vectors that express the polypeptides of interest in cells of the library. The polynucleotides can be synthetically synthesized. The polynucleotides can be cloned by designing primers that amplify the polynucleotides. Primers can be designed using available software, such as Primer3Plus (available the following URL: bioinformatics.nl/cgi-bin/primer3plus/primer3plus.cgi; see Rozen and Skaletsky, In: Krawetz S, Misener S (eds) *Bioinformatics Methods and Protocols: Methods in Molecular Biology*. Humana Press, Totowa, N.J., pp. 365-386, 2000). Other methods for designing primers are known to those of skill in the art. In some embodiments, primers are constructed so as to produce polypeptides that are truncated, and/or lack hydrophobic regions (e.g., signal sequences or transmembrane regions) to promote efficient expression. The location of predicted signal sequences and predicted signal sequence cleavage sites in a given open reading frame (ORF) sequence can be determined using available software, see, e.g., Dyrløv et al., *J. Mol. Biol.*, 340:783-795, 2004, and the following URL: cbs.dtu.dk/services/SignalP/). For example, if a signal sequence is predicted to occur at the N-terminal 20 amino acids of a given polypeptide sequence, a primer is designed to anneal to a coding sequence downstream of the nucleotides encoding the N-terminal 20 amino acids, such that the amplified sequence encodes a product lacking this signal sequence.

Primers can also be designed to include sequences that facilitate subsequent cloning steps. ORFs can be amplified directly from genomic DNA (e.g., genomic DNA of a tumor cell), or from polynucleotides produced by reverse transcription (RT-PCR) of mRNAs expressed by the tumor cell. RT-PCR of mRNA is useful, e.g., when the genomic sequence of interest contains intronic regions. PCR-amplified ORFs are cloned into an appropriate vector, and size, sequence, and expression of ORFs can be verified prior to use in immunological assays.

In some embodiments, a polynucleotide encoding a polypeptide of interest is linked to a sequence encoding a tag (e.g., an N-terminal or C-terminal epitope tag) or a reporter protein (e.g., a fluorescent protein). Epitope tags and reporter proteins facilitate purification of expressed polypeptides, and can allow one to verify that a given polypeptide is properly expressed in a library host cell, e.g., prior to using the cell in a screen. Useful epitope tags include, for example, a polyhistidine (His) tag, a V5 epitope tag from the P and V protein of paramyxovirus, a hemagglutinin (HA) tag, a myc tag, and others. In some embodiments, a polynucleotide encoding a polypeptide of interest is fused to a sequence encoding a tag which is a known antigenic epitope (e.g., an MHC class I- and/or MHC class II-restricted T cell epitope of a model antigen such as an ovalbumin), and which can be used to verify that a polypeptide of interest is expressed and that the polypeptide-tag fusion protein is processed and presented in antigen presentation assays. In some embodiments a tag includes a T cell epitope of a murine T cell (e.g., a murine T cell line). In some embodiments, a polynucleotide encoding a polypeptide of interest is linked to a tag that facilitates purification and a tag that is a known antigenic epitope. Useful reporter proteins include naturally occurring fluorescent proteins and their derivatives, for example, Green Fluorescent Protein (*Aequorea Victoria*) and Neon Green (*Branchiostoma lanceolatum*). Panels of synthetically derived fluorescent and chromogenic proteins are also available from commercial sources.

Polynucleotides encoding a polypeptide of interest are cloned into an expression vector for introduction into library host cells. Various vector systems are available to facilitate cloning and manipulation of polynucleotides, such as the Gateway® Cloning system (Invitrogen). As is known to those of skill in the art, expression vectors include elements that drive production of polypeptides of interest encoded by a polynucleotide in library host cells (e.g., promoter and other regulatory elements). In some embodiments, polypeptide expression is controlled by an inducible element (e.g., an inducible promoter, e.g., an IPTG- or arabinose-inducible promoter, or an IPTG-inducible phage T7 RNA polymerase system, a lactose (lac) promoter, a tryptophan (trp) promoter, a tac promoter, a trc promoter, a phage lambda promoter, an alkaline phosphatase (phoA) promoter, to give just a few examples; see Cantrell, *Meth. in Mol. Biol.,* 235:257-276, Humana Press, Casali and Preston, Eds.). In some embodiments, polypeptides are expressed as cytoplasmic polypeptides. In some embodiments, the vector used for polypeptide expression is a vector that has a high copy number in a library host cell. In some embodiments, the vector used for expression has a copy number that is more than 25, 50, 75, 100, 150, 200, or 250 copies per cell. In some embodiments, the vector used for expression has a ColE1 origin of replication. Useful vectors for polypeptide expression in bacteria include pET vectors (Novagen), Gateway® pDEST vectors (Invitrogen), pGEX vectors (Amersham Biosciences), pPRO vectors (BD Biosciences), pBAD vectors (Invitrogen), pLEX vectors (Invitrogen), pMAL™ vectors (New England BioLabs), pGEMEX vectors (Promega), and pQE vectors (Qiagen). Vector systems for producing phage libraries are known and include Novagen T7Select® vectors, and New England Biolabs Ph.D.™ Peptide Display Cloning System.

In some embodiments, library host cells express (either constitutively, or when induced, depending on the selected expression system) a polypeptide of interest to at least 10%, 20%, 30%, 40%, 50%, 60%, or 70% of the total cellular protein. In some embodiments, the level a polypeptide available in or on a library member (e.g., cell, virus particle, liposome, bead) is such that antigen presenting cells exposed to a sufficient quantity of the library members are presented on MHC molecules polypeptide epitopes at a density that is comparable to the density presented by antigen presenting cells pulsed with purified peptides.

Methods for efficient, large-scale production of libraries are available. For example, site-specific recombinases or rare-cutting restriction enzymes can be used to transfer polynucleotides between expression vectors in the proper orientation and reading frame (Walhout et al., *Meth. Enzymol.* 328:575-592, 2000; Marsischky et al., *Genome Res.* 14:2020-202, 2004; Blommel et al., *Protein Expr. Purif* 47:562-570, 2006).

For production of liposome libraries, expressed polypeptides (e.g., purified or partially purified polypeptides) can be entrapped in liposomal membranes, e.g., as described in Wassef et al., U.S. Pat. No. 4,863,874; Wheatley et al., U.S. Pat. No. 4,921,757; Huang et al., U.S. Pat. No. 4,925,661; or Martin et al., U.S. Pat. No. 5,225,212.

A library can be designed to include full length polypeptides and/or portions of polypeptides. Expression of full length polypeptides maximizes epitopes available for presentation by a human antigen presenting cell, thereby increasing the likelihood of identifying an antigen. However, in some embodiments, it is useful to express portions of polypeptides, or polypeptides that are otherwise altered, to achieve efficient expression. For example, in some embodiments, polynucleotides encoding polypeptides that are large (e.g., greater than 1,000 amino acids), that have extended hydrophobic regions, signal peptides, transmembrane domains, or domains that cause cellular toxicity, are modified (e.g., by C-terminal truncation, N-terminal truncation, or internal deletion) to reduce cytotoxicity and permit efficient expression a library cell, which in turn facilitates presentation of the encoded polypeptides on human cells. Other types of modifications, such as point mutations or codon optimization, may also be used to enhance expression.

The number of polypeptides included in a library can be varied. For example, in some embodiments, a library can be designed to express polypeptides from at least 5%, 10%, 15%, 20%, 25%, 35%, 40%, 45%, 50%, 55%, 60%, 70%, 75%, 80%, 85%, 90%, 95%, 97%, 98%, 99%, or more, of ORFs in a target cell (e.g., tumor cell). In some embodiments, a library expresses at least 10, 15, 20, 25, 30, 40, 50, 75, 100, 150, 200, 250, 300, 350, 400, 450, 500, 550, 600, 650, 700, 750, 800, 850, 900, 950, 1000, 2500, 5000, 10,000, or more different polypeptides of interest, each of which may represent a polypeptide encoded by a single full length polynucleotide or portion thereof.

In some embodiments, assays may focus on identifying antigens that are secreted polypeptides, cell surface-expressed polypeptides, or virulence determinants, e.g., to identify antigens that are likely to be targets of both humoral and cell mediated immune responses.

In addition to polypeptides of interest, libraries can include tags or reporter proteins that allow one to easily purify, analyze, or evaluate MHC presentation, of the polypeptide of interest. In some embodiments, polypeptides expressed by a library include C-terminal tags that include both an MHC class I and an MHC class II-restricted T cell epitope from a model antigen, such as chicken ovalbumin (OVA). Library protein expression and MHC presentation is validated using these epitopes. In some embodiments, the epitopes are $OVA_{247-265}$ and $OVA_{258-265}$ respectfully, corresponding to positions in the amino acid sequence found in GenBank® under Acc. No. NP_990483. Expression and presentation of linked ORFs can be verified with antigen presentation assays using T cell hybridomas (e.g., B3Z T hybridoma cells, which are H2-$K^b$ restricted, and KZO T hybridoma cells, which are H2-$A^k$ restricted) that specifically recognize these epitopes.

Sets of library members (e.g., bacterial cells) can be provided on an array (e.g., on a solid support, such as a 96-well plate) and separated such that members in each location express a different polypeptide of interest, or a different set of polypeptides of interest.

Methods of using library members for identifying T cell antigens are described in detail below. In addition to these methods, library members also have utility in assays to identify B cell antigens. For example, lysate prepared from library members that include polypeptides of interest can be used to screen a sample comprising antibodies (e.g., a serum sample) from a subject (e.g., a subject who has been exposed to an infectious agent of interest, a subject who has cancer, and/or a control subject), to determine whether antibodies present in the subject react with the polypeptide of interest. Suitable methods for evaluating antibody reactivity are known and include, e.g., ELISA assays.

Polypeptides of Interest

In some embodiments, methods and compositions described herein can be used to identify and/or detect immune responses to a polypeptide of interest. In some embodiments, a polypeptide of interest is encoded by an ORF from a target tumor cell, and members of a library include (e.g., internally express or carry) ORFs from a target tumor cell. In some such embodiments, a library can be used in methods described herein to assess immune responses to one or more polypeptides of interest encoded by one or more ORFs. In some embodiments, methods of the disclosure identify one or more polypeptides of interest as stimulatory antigens (e.g., that stimulate an immune response, e.g., a T cell response, e.g., expression and/or secretion of one or more immune mediators). In some embodiments, methods of the disclosure identify one or more polypeptides of interest as antigens or potential antigens that have minimal or no effect on an immune response (e.g., expression and/or secretion of one or more immune mediators). In some embodiments, methods of the disclosure identify one or more polypeptides of interest as inhibitory and/or suppressive antigens (e.g., that inhibit, suppress, down-regulate, impair, and/or prevent an immune response, e.g., a T cell response, e.g., expression and/or secretion of one or more immune mediators). In some embodiments, methods of the disclosure identify one or more polypeptides of interest as tumor antigens or potential tumor antigens, e.g., tumor specific antigens (TSAs, or neoantigens), tumor associated antigens (TAAs), or cancer/testis antigens (CTAs).

In some embodiments, a polypeptide of interest is a putative tumor antigen, and methods and compositions described herein can be used to identify and/or detect immune responses to one or more putative tumor antigens. For example, members of a library include (e.g., internally express or carry) putative tumor antigens (e.g., a polypeptide previously identified (e.g., by a third party) as a tumor antigen, e.g., identified as a tumor antigen using a method other than a method of the present disclosure). In some embodiments, a putative tumor antigen is a tumor antigen described herein. In some such embodiments, such libraries can be used to assess whether and/or the extent to which such putative tumor antigen mediates an immune response. In some embodiments, methods of the disclosure identify one or more putative tumor antigens as stimulatory antigens. In some embodiments, methods of the disclosure identify one or more putative tumor antigens as antigens that have minimal or no effect on an immune response. In some embodiments, methods of the disclosure identify one or more putative tumor antigens as inhibitory and/or suppressive antigens.

In some embodiments, a polypeptide of interest is a pre-selected tumor antigen, and methods and compositions described herein can be used to identify and/or detect immune responses to one or more pre-selected tumor antigens. For example, in some embodiments, members of a library include (e.g., internally express or carry) one or more polypeptides identified as tumor antigens using a method of the present disclosure and/or using a method other than a method of the present disclosure. In some such embodiments, such libraries can be used to assess whether and/or the extent to which such tumor antigens mediate an immune response by an immune cell from one or more subjects (e.g., a subject who has cancer and/or a control subject) to obtain one or more response profiles described herein. In some embodiments, methods of the disclosure identify one or more pre-selected tumor antigens as stimulatory antigens for one or more subjects. In some embodiments, methods of the disclosure identify one or more pre-selected tumor antigens as antigens that have minimal or no effect on an immune response for one or more subjects. In some embodiments, methods of the disclosure identify one or more pre-selected tumor antigens as inhibitory and/or suppressive antigens for one or more subjects.

In some embodiments, a polypeptide of interest is a known tumor antigen, and methods and compositions described herein can be used to identify and/or detect immune responses to one or more known tumor antigens. For example, in some embodiments, members of a library include (e.g., internally express or carry) one or more polypeptides identified as a tumor antigen using a method of the present disclosure and/or using a method other than a method of the present disclosure. In some such embodiments, such libraries can be used to assess whether and/or the extent to which such tumor antigens mediate an immune response by an immune cell from one or more subjects (e.g., a subject who has cancer and/or a control subject) to obtain one or more response profiles described herein. In some embodiments, methods of the disclosure identify one or more known tumor antigens as stimulatory antigens for one or more subjects. In some embodiments, methods of the disclosure identify one or more known tumor antigens as antigens that have minimal or no effect on an immune response for one or more subjects. In some embodiments, methods of the disclosure identify one or more known tumor antigens as inhibitory and/or suppressive antigens for one or more subjects.

In some embodiments, a polypeptide of interest is a potential tumor antigen, and methods and compositions described herein can be used to identify and/or detect immune responses to one or more potential tumor antigens. For example, in some embodiments, members of a library include (e.g., internally express or carry) one or more polypeptides identified as being of interest, e.g., encoding mutations associated with a tumor, using a method of the present disclosure and/or using a method other than a method of the present disclosure. In some such embodiments, such libraries can be used to assess whether and/or the extent to which such polypeptides mediate an immune response by an immune cell from one or more subjects (e.g., a subject who has cancer and/or a control subject) to obtain one or more response profiles described herein. In some embodiments, methods of the disclosure identify one or more polypeptides as stimulatory antigens for one or more subjects. In some embodiments, methods of the disclosure identify one or more polypeptides as antigens that have minimal or no effect on an immune response for one or more subjects. In some embodiments, methods of the disclosure identify one or more polypeptides as inhibitory and/or suppressive antigens for one or more subjects.

Tumor Antigens

Polypeptides of interest used in methods and systems described herein include tumor antigens and potential tumor antigens, e.g., tumor specific antigens (TSAs, or neoantigens), tumor associated antigens (TAAs), and/or cancer/testis antigens (CTAs). Exemplary tumor antigens include, e.g., MART-1/MelanA (MART-I or MLANA), gp100 (Pmel 17 or SILV), tyrosinase, TRP-1, TRP-2, MAGE-1, MAGE-3 (also known as HIP8), BAGE, GAGE-1, GAGE-2, p15, Calcitonin, Calretinin, Carcinoembryonic antigen (CEA), Chromogranin, Cytokeratin, Desmin, Epithelial membrane protein (EMA), Factor VIII, Glial fibrillary acidic protein (GFAP), Gross cystic disease fluid protein (GCDFP-15), HMB-45, Human chorionic gonadotropin (hCG), inhibin, lymphocyte marker, MART-1 (Melan-A), Myo D1, muscle-specific actin (MSA), neurofilament, neuron-specific enolase (NSE), placental alkaline phosphatase (PLAP), prostate-specific antigen, PTPRC (CD45), S100 protein, smooth muscle actin (SMA), synaptophysin, thyroglobulin, thyroid transcription factor-1, Tumor M2-PK, vimentin, p53, Ras, HER-2/neu, BCR-ABL, E2A-PRL, H4-RET, IGH-IGK, MYL-RAR, Epstein Barr virus antigens (e.g., EBNA1), human papillomavirus (HPV) antigen E6 or E7 (HPV_E6 or HPV_E7), TSP-180, MAGE-4, MAGE-5, MAGE-6, RAGE, NY-ESO-1 (also known as CTAG1B), erbB, p185erbB2, p180erbB-3, c-met, nm-23H1, PSA, TAG-72, CA 19-9, CA 72-4, CAM 17.1, NuMa, K-ras, beta-Catenin, CDK4, Mum-1, p 15, p 16, 43-9F, 5T4, 791Tgp72, alpha-fetoprotein (AFP), beta-HCG, BCA225, BTAA, CA 125, CA 15-3\CA 27.29\BCAA, CA 195, CA 242, CA-50, CAM43, CD68\P1, CO-029, FGF-5, G250, Ga733\EpCAM, HTgp-175, M344, MA-50, MG7-Ag, MOV18, NB/70K, NY-CO-1, RCAS1, SDCCAG16, TA-90\Mac-2 binding protein\cyclophilin C-associated protein, TAAL6, TAG72, TLP, MUC16, IL13Rα2, FRα, VEGFR2, Lewis Y, FAP, EphA2, CEACAM5, EGFR, CA6, CA9, GPNMB, EGP1, FOLR1, endothelial receptor, STEAP1, SLC44A4, Nectin-4, AGS-16, guanalyl cyclase C, MUC-1, CFC1B, integrin alpha 3 chain (of a3b1, a laminin receptor chain), TPS, CD19, CD20, CD22, CD30, CD31, CD72, CD180, CD171 (L1CAM), CD123, CD133, CD138, CD37, CD70, CD79a, CD79b, CD56, CD74, CD166, CD71, CD34, CD99, CD117, CD80, CD28, CD13, CD15, CD25, CD10, CLL-1/ CLEC12A, ROR1, Glypican 3 (GPC3), Mesothelin, CD33/IL3Ra, c-Met, PSCA, PSMA, Glycolipid F77, EGFRvIII, BCMA, GD-2, PSAP, prostein (also known as P501S), PSMA, Survivin (also known as BIRC5), and MAGE-A3, MAGEA2, MAGEA4, MAGEA6, MAGEA9, MAGEA10, MAGEA12, BIRC5, CDH3, CEACAM3, CGB_isoform2, ELK4, ERBB2, HPSE1, HPSE2, KRAS isoform1, KRAS isoform2, MUC1, SMAD4, TERT,2. TERT.3, TGFBR2, EGAG9_isoform1, TP53, CGB_isoform1, IMPDH2, LCK, angiopoietin-1 (Ang1) (also known as ANGPT1), XIAP (also known as BIRC4), galectin-3 (also known as LGALS3), VEGF-A (also known as VEGF), ATP6S1 (also known as ATP6AP1), MAGE-A1, cIAP-1 (also known as BIRC2), macrophage migration inhibitory factor (MIF), galectin-9 (also known as LGALS9), progranulin PGRN (also known as granulin), OGFR, MLIAP (also known as BIRC7), TBX4 (also known as ICPPS, SPS or T-Box4), secretory leukocyte protein inhibitor (Slpi) (also known as antileukoproteinase), Ang2 (also known as ANGPT2), galectin-1 (also known as LGALS1), TRP-2 (also known as DCT), hTERT (telomerase reverse transcriptase) tyrosinase-related protein 1 (TRP-1, TYRP1), NOR-90/UBF-2 (also known as UBTF), LGMN, SPA17, PRTN3, TRRAP_1, TRRAP_2, TRRAP_3, TRRAP_4, MAGEC2, PRAME, SOX10, RAC1, HRAS, GAGE4, AR, CYP1B1, MMP8, TYR, PDGFRB, KLK3, PAX3, PAX5, ST3GAL5, PLAC1, RhoC, MYCN, REG3A, CSAG2, CTAG2-1a, CTAG2-1b, PAGE4, BRAF, GRM3, ERBB4, KIT, MAPK1, MFI2, SART3, ST8SIA1, WDR46, AKAP-4, RGS5, FOSL1, PRM2, ACRBP, CTCFL, CSPG4, CCNB1, MSLN, WT1, SSX2, KDR, ANKRD30A, MAGEDI, MAP3K9, XAGE1B, PREX2, CD276, TEK, AIM1, ALK, FOLH1, GRIN2A MAP3K5 and one or more isoforms of any preceding tumor antigens. Exemplary tumor antigens are provided in the accompanying list of sequences.

Tumor specific antigens (TSAs, or neoantigens) are tumor antigens that are not encoded in normal host genome (see, e.g., Yarchoan et al., Nat. Rev. Cancer. 2017 Feb. 24. doi: 10.1038/nrc.2016.154; Gubin et al., J. Clin. Invest. 125: 3413-3421 (2015)). In some embodiments, TSAs arise from somatic mutations and/or other genetic alterations. In some embodiments, TSAs arise from missense or in-frame mutations. In some embodiments, TSAs arise from frame-shift mutations or loss-of-stop-codon mutations. In some embodiments, TSAs arise from insertion or deletion mutations. In some embodiments, TSAs arise from duplication or repeat expansion mutations. In some embodiments, TSAs arise from splice variants or improper splicing. In some embodiments, TSAs arise from gene fusions. In some embodiments, TSAs arise from translocations. In some embodiments, TSAs include oncogenic viral proteins. For example, as with Merkel cell carcinoma (MCC) associated with the Merkel cell polyomavirus (MCPyV) and cancers of the cervix, oropharynx and other sites associated with the human papillomavirus (HPV), TSAs include proteins encoded by viral open reading frames. For purposes of this disclosure, the terms "mutation" and "mutations" encompass all mutations and genetic alterations that may give rise to an antigen encoded in the genome of a cancer or tumor cell of a subject, but not in a normal or non-cancerous cell of the same subject. In some embodiments, TSAs are specific (personal) to a subject. In some embodiments, TSAs are shared by more than one subject, e.g., less than 1%, 1-3%, 1-5%, 1-10%, or more of subjects suffering from a cancer. In some embodiments, TSAs shared by more than one subject may be known or pre-selected.

In some embodiments, a TSA is encoded by an open reading frame from a virus. For example, a library can be designed to express polypeptides from one of the following viruses: an immunodeficiency virus (e.g., a human immunodeficiency virus (HIV), e.g., HIV-1, HIV-2), a hepatitis virus (e.g., hepatitis B virus (HBV), hepatitis C virus (HCV), hepatitis A virus, non-A and non-B hepatitis virus), a herpes virus (e.g., herpes simplex virus type I (HSV-1), HSV-2, Varicella-zoster virus, Epstein Barr virus, human cytomegalovirus, human herpesvirus 6 (HHV-6), HHV-7, HHV-8), a poxvirus (e.g., variola, vaccinia, monkeypox, Molluscum contagiosum virus), an influenza virus, a human papilloma virus, adenovirus, rhinovirus, coronavirus, respiratory syncytial virus, rabies virus, coxsackie virus, human T cell leukemia virus (types I, II and III), parainfluenza virus, paramyxovirus, poliovirus, rotavirus, rhinovirus, rubella virus, measles virus, mumps virus, adenovirus, yellow fever virus, Norwalk virus, West Nile virus, a Dengue virus, Severe Acute Respiratory Syndrome Coronavirus (SARS-CoV), bunyavirus, Ebola virus, Marburg virus, Eastern equine encephalitis virus, Venezuelan equine encephalitis virus, Japanese encephalitis virus, St. Louis encephalitis virus, Junin virus, Lassa virus, and Lymphocytic choriomeningitis virus. Libraries for other viruses can also be produced and used according to methods described herein.

Tumor specific antigens are known in the art, any of which can be used in methods described herein. In some embodiments, gene sequences encoding polypeptides that are potential or putative neoantigens are determined by sequencing the genome and/or exome of tumor tissue and healthy tissue from a subject having cancer using next generation sequencing technologies. In some embodiments, genes that are selected based on their frequency of mutation and ability to encode a potential or putative neoantigen are sequenced using next-generation sequencing technology. Next-generation sequencing applies to genome sequencing, genome resequencing, transcriptome profiling (RNA-Seq), DNA-protein interactions (ChIP-sequencing), and epigenome characterization (de Magalhaes et al. (2010) Ageing Research Reviews 9 (3): 315-323; Hall N (2007) J. Exp. Biol. 209 (Pt 9): 1518-1525; Church (2006) Sci. Am. 294 (1): 46-54; ten Bosch et al. (2008) Journal of Molecular Diagnostics 10 (6): 484-492; Tucker T et al. (2009) The American Journal of Human Genetics 85 (2): 142-154). Next-generation sequencing can be used to rapidly reveal the presence of discrete mutations such as coding mutations in individual tumors, e.g., single amino acid changes (e.g., missense mutations, in-frame mutations) or novel stretches of amino acids generated by frame-shift insertions, deletions, gene fusions, read-through mutations in stop codons, duplication or repeat expansion mutations, and translation of splice variants or improperly spliced introns, and translocations (e.g., "neoORFs").

Another method for identifying potential or putative neoantigens is direct protein sequencing. Protein sequencing of enzymatic digests using multidimensional MS techniques (MSn) including tandem mass spectrometry (MS/MS)) can also be used to identify neoantigens. Such proteomic approaches can be used for rapid, highly automated analysis (see, e.g., Gevaert et al., Electrophoresis 21:1145-1154 (2000)). High-throughput methods for de novo sequencing of unknown proteins can also be used to analyze the proteome of a subject's tumor to identify expressed potential or putative neoantigens. For example, meta shotgun protein sequencing may be used to identify expressed potential or putative neoantigens (see e.g., Guthals et al. (2012) Molecular and Cellular Proteomics 11(10): 1084-96).

Potential or putative neoantigens may also be identified using MHC multimers to identify neoantigen-specific T cell responses. For example, high-throughput analysis of neoantigen-specific T cell responses in patient samples may be performed using MHC tetramer-based screening techniques (see e.g., Hombrink et al. (2011) PLoS One; 6(8): e22523; Hadrup et al. (2009) Nature Methods, 6(7):520-26; van Rooij et al. (2013) Journal of Clinical Oncology, 31:1-4; and Heemskerk et al. (2013) EMBO Journal, 32(2):194-203).

In some embodiments, one or more known or pre-selected tumor specific antigens, or one or more potential or putative tumor specific antigens identified using one of these methods, can be included in a library described herein.

Tumor associated antigens (TAAs) include proteins encoded in a normal genome (see, e.g., Ward et al., Adv. Immunol. 130:25-74 (2016)). In some embodiments, TAAs are either normal differentiation antigens or aberrantly expressed normal proteins. Overexpressed normal proteins that possess growth/survival-promoting functions, such as Wilms tumor 1 (WT1) (Ohminami et al., Blood 95:286-293 (2000)) or Her2/neu (Kawashima et al., Cancer Res. 59:431-435 (1999)), are TAAs that directly participate in the oncogenic process. Post-translational modifications, such as phosphorylation, of proteins may also lead to formation of TAAs (Doyle, J. Biol. Chem. 281:32676-32683 (2006); Cobbold, Sci. Transl. Med. 5:203ra125 (2013)). TAAs are generally shared by more than one subject, e.g., less than 1%, 1-3%, 1-5%, 1-10%, 1-20%, or more of subjects suffering from a cancer. In some embodiments, TAAs are known or pre-selected tumor antigens. In some embodiments, with respect to an individual subject, TAAs are potential or putative tumor antigens. Cancer/testis antigens (CTAs) are expressed by various tumor types and by reproductive tissues (for example, testes, fetal ovaries and trophoblasts) but have limited or no detectable expression in other normal tissues in the adult and are generally not presented on normal reproductive cells, because these tissues do not express MHC class I molecules (see, e.g., Coulie et al., Nat. Rev. Cancer 14:135-146 (2014); Simpson et al., Nat. Rev. Cancer 5:615-625 (2005); Scanlan et al., Immunol. Rev. 188:22-32 (2002)). Library Screens Human Cells for Antigen Presentation The present invention provides, inter alia, compositions and methods for identifying tumor antigens recognized by human immune cells. Human antigen presenting cells express ligands for antigen receptors and other immune activation molecules on human lymphocytes. Given differences in MHC peptide binding specificities and antigen processing enzymes between species, antigens processed and presented by human cells are more likely to be physiologically relevant human antigens in vivo than antigens identified in non-human systems. Accordingly, methods of identifying these antigens employ human cells to present candidate tumor antigen polypeptides. Any human cell that internalizes library members and presents polypeptides expressed by the library members on MHC molecules can be used as an antigen presenting cell according to the present disclosure. In some embodiments, human cells used for antigen presentation are primary human cells. The cells can include peripheral blood mononuclear cells (PBMC) of a human. In some embodiments, peripheral blood cells are separated into subsets (e.g., subsets comprising dendritic cells, macrophages, monocytes, B cells, or combinations thereof) prior to use in an antigen presentation assay. In some embodiments, a subset of cells that expresses MHC class II is selected from peripheral blood. In one example, a cell population including dendritic cells is isolated from peripheral blood. In some embodiments, a subset of dendritic cells is isolated (e.g., plasmacytoid, myeloid, or a subset thereof). Human dendritic cell markers include CD1c, CD1a, CD303, CD304, CD141, and CD209. Cells can be selected based on expression of one or more of these markers (e.g., cells that express CD303, CD1c, and CD141).

Dendritic cells can be isolated by positive selection from peripheral blood using commercially available kits (e.g., from Miltenyi Biotec Inc.). In some embodiments, the dendritic cells are expanded ex vivo prior to use in an assay. Dendritic cells can also be produced by culturing peripheral blood cells under conditions that promote differentiation of monocyte precursors into dendritic cells in vitro. These conditions typically include culturing the cells in the presence of cytokines such as GM-CSF and IL-4 (see, e.g., Inaba et al., Isolation of dendritic cells, Curr. Protoc. Immunol. May; Chapter 3: Unit 3.7, 2001). Procedures for in vitro expansion of hematopoietic stem and progenitor cells (e.g., taken from bone marrow or peripheral blood), and differentiation of these cells into dendritic cells in vitro, is described in U.S. Pat. No. 5,199,942, and U.S. Pat. Pub. 20030077263. Briefly, $CD34^+$ hematopoietic stem and progenitor cells are isolated from peripheral blood or bone marrow and expanded in vitro in culture conditions that include one or more of Flt3-L, IL-1, IL-3, and c-kit ligand.

In some embodiments, immortalized cells that express human MHC molecules (e.g., human cells, or non-human cells that are engineered to express human MHC molecules) are used for antigen presentation. For example, assays can employ COS cells transfected with human MHC molecules or HeLa cells.

In some embodiments, both the antigen presenting cells and immune cells used in the method are derived from the same subject (e.g., autologous T cells and APC are used). In these embodiments, it can be advantageous to sequentially isolate subsets of cells from peripheral blood of the subject, to maximize the yield of cells available for assays. For example, one can first isolate $CD4^+$ and $CD8^+$ T cell subsets from the peripheral blood. Next, dendritic cells (DC) are isolated from the T cell-depleted cell population. The remaining T- and DC-depleted cells are used to supplement the DC in assays, or are used alone as antigen presenting cells. In some embodiments, DC are used with T- and DC-depleted cells in an assay, at a ratio of 1:2, 1:3, 1:4, or 1:5. In some embodiments, the antigen presenting cells and immune cells used in the method are derived from different subjects (e.g., heterologous T cells and APC are used).

Antigen presenting cells can be isolated from sources other than peripheral blood. For example, antigen presenting cells can be taken from a mucosal tissue (e.g., nose, mouth, bronchial tissue, tracheal tissue, the gastrointestinal tract, the genital tract (e.g., vaginal tissue), or associated lymphoid tissue), peritoneal cavity, lymph nodes, spleen, bone marrow, thymus, lung, liver, kidney, neuronal tissue, endocrine tissue, or other tissue, for use in screening assays. In some embodiments, cells are taken from a tissue that is the site of an active immune response (e.g., an ulcer, sore, or abscess). Cells may be isolated from tissue removed surgically, via lavage, or other means.

Antigen presenting cells useful in methods described herein are not limited to "professional" antigen presenting cells. In some embodiments, non-professional antigen presenting cells can be utilized effectively in the practice of methods of the present disclosure. Non-professional antigen presenting cells include fibroblasts, epithelial cells, endothelial cells, neuronal/glial cells, lymphoid or myeloid cells that are not professional antigen presenting cells (e.g., T cells, neutrophils), muscle cells, liver cells, and other types of cells.

Antigen presenting cells are cultured with library members that express a polypeptide of interest (and, if desired, a cytolysin polypeptide) under conditions in which the antigen presenting cells internalize, process and present polypeptides expressed by the library members on MHC molecules. In some embodiments, library members are killed or inactivated prior to culture with the antigen presenting cells. Cells or viruses can be inactivated by any appropriate agent (e.g., fixation with organic solvents, irradiation, freezing). In some embodiments, the library members are cells that express ORFs linked to a tag (e.g., a tag which comprises one or more known T cell epitopes) or reporter protein, expression of which has been verified prior to the culturing.

In some embodiments, antigen presenting cells are incubated with library members at 37° C. for between 30 minutes and 5 hours (e.g., for 45 min. to 1.5 hours). After the incubation, the antigen presenting cells can be washed to remove library members that have not been internalized. In certain embodiments, the antigen presenting cells are non-adherent, and washing requires centrifugation of the cells. The washed antigen presenting cells can be incubated at 37° C. for an additional period of time (e.g., 30 min. to 2 hours) prior to exposure to lymphocytes, to allow antigen processing. In some embodiments, it is desirable to fix and kill the antigen presenting cells prior to exposure to lymphocytes (e.g., by treating the cells with 1% paraformaldehyde).

The antigen presenting cell and library member numbers can be varied, so long as the library members provide quantities of polypeptides of interest sufficient for presentation on MHC molecules. In some embodiments, antigen presenting cells are provided in an array, and are contacted with sets of library cells, each set expressing a different polypeptide of interest. In certain embodiments, each location in the array includes $1\times10^3$-$1\times10^6$ antigen presenting cells, and the cells are contacted with $1\times10^3$-$1\times10^8$ library cells which are bacterial cells.

In any of the embodiments described herein, antigen presenting cells can be freshly isolated, maintained in culture, and/or thawed from frozen storage prior to incubation with library cells, or after incubation with library cells.

Human Lymphocytes

In methods of the present disclosure, human lymphocytes are tested for antigen-specific reactivity to antigen presenting cells, e.g., antigen presenting cells that have been incubated with libraries expressing polypeptides of interest as described above. The methods of the present disclosure permit rapid identification of human antigens using pools of lymphocytes isolated from an individual, or progeny of the cells. The detection of antigen-specific responses does not rely on laborious procedures to isolate individual T cell clones. In some embodiments, the human lymphocytes are primary lymphocytes. In some embodiments, human lymphocytes are NKT cells, gamma-delta T cells, or NK cells. Just as antigen presenting cells may be separated into subsets prior to use in antigen presentation assays, a population of lymphocytes having a specific marker or other feature can be used. In some embodiments, a population of T lymphocytes is isolated. In some embodiments, a population of $CD4^+$ T cells is isolated. In some embodiments, a population of $CD8^+$ T cells is isolated. $CD8^+$ T cells recognize peptide antigens presented in the context of MHC class I molecules. Thus, in some embodiments, the $CD8^+$ T cells are used with antigen presenting cells that have been exposed to library host cells that co-express a cytolysin polypeptide, in addition to a polypeptide of interest. T cell subsets that express other cell surface markers may also be isolated, e.g., to provide cells having a particular phenotype. These include CLA (for skin-homing T cells), CD25, CD30, CD69, CD154 (for activated T cells), CD45RO (for memory T cells), CD294 (for Th2 cells), γ/δ TCR-expressing cells, CD3 and CD56 (for NK T cells). Other subsets can also be selected.

Lymphocytes can be isolated, and separated, by any means known in the art (e.g., using antibody-based methods such as those that employ magnetic bead separation, panning, or flow cytometry). Reagents to identify and isolate human lymphocytes and subsets thereof are well known and commercially available.

Lymphocytes for use in methods described herein can be isolated from peripheral blood mononuclear cells, or from other tissues in a human. In some embodiments, lymphocytes are taken from tumors, lymph nodes, a mucosal tissue (e.g., nose, mouth, bronchial tissue, tracheal tissue, the gastrointestinal tract, the genital tract (e.g., vaginal tissue), or associated lymphoid tissue), peritoneal cavity, spleen, thymus, lung, liver, kidney, neuronal tissue, endocrine tissue, peritoneal cavity, bone marrow, or other tissues. In some embodiments, cells are taken from a tissue that is the site of an active immune response (e.g., an ulcer, sore, or abscess). Cells may be isolated from tissue removed surgically, via lavage, or other means.

Lymphocytes taken from an individual can be maintained in culture or frozen until use in antigen presentation assays. In some embodiments, freshly isolated lymphocytes can be stimulated in vitro by antigen presenting cells exposed to library cells as described above. In some embodiments, these lymphocytes exhibit detectable stimulation without the need for prior non-antigen specific expansion. However, primary lymphocytes also elicit detectable antigen-specific responses when first stimulated non-specifically in vitro. Thus, in some embodiments, lymphocytes are stimulated to proliferate in vitro in a non-antigen specific manner, prior to use in an antigen presentation assay. Lymphocytes can also be stimulated in an antigen-specific manner prior to use in an antigen presentation assay. In some embodiments, cells are stimulated to proliferate by a library (e.g., prior to use in an antigen presentation assay that employs the library). Expanding cells in vitro provides greater numbers of cells for use in assays. Primary T cells can be stimulated to expand, e.g., by exposure to a polyclonal T cell mitogen, such as phytohemagglutinin or concanavalin, by treatment with antibodies that stimulate proliferation, or by treatment with particles coated with the antibodies. In some embodiments, T cells are expanded by treatment with anti-CD2, anti-CD3, and anti-CD28 antibodies. In some embodiments, T cells are expanded by treatment with interleukin-2. In some embodiments, lymphocytes are thawed from frozen storage and expanded (e.g., stimulated to proliferate, e.g., in a non-antigen specific manner or in an antigen-specific manner) prior to contacting with antigen presenting cells. In some embodiments, lymphocytes are thawed from frozen storage and are not expanded prior to contacting with antigen presenting cells. In some embodiments, lymphocytes are freshly isolated and expanded (e.g., stimulated to proliferate, e.g., in a non-antigen specific manner or in an antigen-specific manner) prior to contacting with antigen presenting cells.

Antigen Presentation Assays

In antigen presentation assays, T cells are cultured with antigen presenting cells prepared according to the methods described above, under conditions that permit T cell recognition of peptides presented by MHC molecules on the antigen presenting cells. In some embodiments, T cells are incubated with antigen presenting cells at 37° C. for between 12-48 hours (e.g., for 24 hours). In some embodiments, T cells are incubated with antigen presenting cells at 37° C. for 3, 4, 5, 6, 7, or 8 days. Numbers of antigen presenting cells and T cells can be varied. In some embodiments, the ratio of T cells to antigen presenting cells in a given assay is 1:10, 1:5, 1:2, 1:1, 2:1, 5:1, 10:1, 20:1, 25:1, 30:1, 32:1, 35:1 or 40:1. In some embodiments, antigen presenting cells are provided in an array (e.g., in a 96-well plate), wherein cells in each location of the array have been contacted with sets of library cells, each set including a different polypeptide of interest. In certain embodiments, each location in the array includes $1 \times 10^3$-$1 \times 10^6$ antigen presenting cells, and the cells are contacted with $1 \times 10^3$-$1 \times 10^6$ T cells.

After T cells have been incubated with antigen presenting cells, cultures are assayed for activation. Lymphocyte activation can be detected by any means known in the art, e.g., T cell proliferation, phosphorylation or dephosphorylation of a receptor, calcium flux, cytoskeletal rearrangement, increased or decreased expression and/or secretion of immune mediators such as cytokines or soluble mediators, increased or decreased expression of one or more cell surface markers. In some embodiments, culture supernatants are harvested and assayed for increased and/or decreased expression and/or secretion of one or more polypeptides associated with activation, e.g., a cytokine, soluble mediator, cell surface marker, or other immune mediator. In some embodiments, the one or more cytokines are selected from TRAIL, IFN-gamma, IL-12p70, IL-2, TNF-alpha, MIP1-alpha, MIP1-beta, CXCL9, CXCL10, MCP1, RANTES, IL-1 beta, IL-4, IL-6, IL-8, IL-9, IL-10, IL-13, IL-15, CXCL11, IL-3, IL-5, IL-17, IL-18, IL-21, IL-22, IL-23A, IL-24, IL-27, IL-31, IL-32, TGF-beta, CSF, GM-CSF, TRANCE (also known as RANK L), MIP3-alpha, and fractalkine. In some embodiments, the one or more soluble mediators are selected from granzyme A, granzyme B, sFas, sFasL, perforin, and granulysin. In some embodiments, the one or more cell surface markers are selected from CD107a, CD107b, CD25, CD69, CD45RA, CD45RO, CD137 (4-1BB), CD44, CD62L, CD27, CCR7, CD154 (CD40L), KLRG-1, CD71, HLA-DR, CD122 (IL-2RB), CD28, IL7Ra (CD127), CD38, CD26, CD134 (OX-40), CTLA-4 (CD152), LAG-3, TIM-3 (CD366), CD39, PD1 (CD279), FoxP3, TIGIT, CD160, BTLA, 2B4 (CD244), and KLRG1. Cytokine secretion in culture supernatants can be detected, e.g., by ELISA, bead array, e.g., with a Luminex® analyzer. Cytokine production can also be assayed by RT-PCR of mRNA isolated from the T cells, or by ELISPOT analysis of cytokines released by the T cells. In some embodiments, proliferation of T cells in the cultures is determined (e.g., by detecting $^3$H thymidine incorporation). In some embodiments, target cell lysis is determined (e.g., by detecting T cell dependent lysis of antigen presenting cells labeled with $Na_2\ ^{51}CrO_4$). Target cell lysis assays are typically performed with CD8$^+$ T cells. Protocols for these detection methods are known. See, e.g., *Current Protocols In Immunology*, John E. Coligan et al. (eds), Wiley and Sons, New York, N.Y., 2007. One of skill in the art understands that appropriate controls are used in these detection methods, e.g., to adjust for non-antigen specific background activation, to confirm the presenting capacity of antigen presenting cells, and to confirm the viability of lymphocytes.

In some embodiments, antigen presenting cells and lymphocytes used in the method are from the same individual. In some embodiments, antigen presenting cells and lymphocytes used in the method are from different individuals.

In some embodiments, antigen presentation assays are repeated using lymphocytes from the same individual that have undergone one or more previous rounds of exposure to antigen presenting cells, e.g., to enhance detection of responses, or to enhance weak initial responses. In some embodiments, antigen presentation assays are repeated using antigen presenting cells from the same individual that have undergone one or more previous rounds of exposure to a library, e.g., to enhance detection of responses, or to enhance weak initial responses. In some embodiments, antigen presentation assays are repeated using lymphocytes from the same individual that have undergone one or more previous rounds of exposure to antigen presenting cells, and antigen presenting cells from the same individual that have undergone one or more previous rounds of exposure to a library, e.g., to enhance detection of responses, or to enhance weak initial responses. In some embodiments, antigen presentation assays are repeated using antigen presenting cells and lymphocytes from different individuals, e.g., to identify antigens recognized by multiple individuals, or compare reactivities that differ between individuals.

Methods of Identifying Tumor Antigens

One advantage of methods described herein is their ability to identify clinically relevant human antigens. Humans that have cancer may have lymphocytes that specifically recognize tumor antigens, which are the product of an adaptive immune response arising from prior exposure. In some embodiments, these cells are present at a higher frequency than cells from an individual who does not have cancer, and/or the cells are readily reactivated when re-exposed to the proper antigenic stimulus (e.g., the cells are "memory" cells). Thus, humans that have or have had cancer are particularly useful donors of cells for identifying antigens in vitro. The individual may be one who has recovered from cancer. In some embodiments, the individual has been recently diagnosed with cancer (e.g., the individual was diagnosed less than one year, three months, two months, one month, or two weeks, prior to isolation of lymphocytes and/or antigen presenting cells from the individual). In some embodiments, the individual was first diagnosed with cancer more than three months, six months, or one year prior to isolation of lymphocytes and/or antigen presenting cells.

In some embodiments, lymphocytes are screened against antigen presenting cells that have been contacted with a library of cells whose members express or carry polypeptides of interest, and the lymphocytes are from an individual who has not been diagnosed with cancer. In some embodiments, such lymphocytes are used to determine background (i.e., non-antigen-specific) reactivities. In some embodiments, such lymphocytes are used to identify antigens, reactivity to which exists in non-cancer individuals.

Cells from multiple donors (e.g., multiple subjects who have cancer) can be collected and assayed in methods described herein. In some embodiments, cells from multiple donors are assayed in order to determine if a given tumor antigen is reactive in a broad portion of the population, or to identify multiple tumor antigens that can be later combined to produce an immunogenic composition that will be effective in a broad portion of the population.

Antigen presentation assays are useful in the context of both infectious and non-infectious diseases. The methods described herein are applicable to any context in which a rapid evaluation of human cellular immunity is beneficial. In some embodiments, antigenic reactivity to polypeptides that are differentially expressed by neoplastic cells (e.g., tumor cells) is evaluated. Sets of nucleic acids differentially expressed by neoplastic cells have been identified using established techniques such as subtractive hybridization. Methods described herein can be used to identify antigens that were functional in a subject in which an anti-tumor immune response occurred. In other embodiments, methods are used to evaluate whether a subject has lymphocytes that react to a tumor antigen or set of tumor antigens.

In some embodiments, antigen presentation assays are used to examine reactivity to autoantigens in cells of an individual, e.g., an individual predisposed to, or suffering from, an autoimmune condition. Such methods can be used to provide diagnostic or prognostic indicators of the individual's disease state, or to identify autoantigens. For these assays, in some embodiments, libraries that include an array of human polypeptides are prepared. In some embodiments, libraries that include polypeptides from infectious agents which are suspected of eliciting cross-reactive responses to autoantigens are prepared. For examples of antigens from infectious agents thought to elicit cross-reactive autoimmune responses, see Barzilai et al., *Curr Opin Rheumatol.*, 19(6):636-43, 2007; Ayada et al., *Ann N Y Acad Sci.*, 1108:594-602, 2007; Drouin et al., *Mol Immunol.*, 45(1): 180-9, 2008; and Bach, *J Autoimmun.*, 25 Suppl:74-80, 2005.

As discussed, the present disclosure includes methods in which polypeptides of interest are included in a library (e.g., expressed in library cells or carried in or on particles or beads). After members of the library are internalized by antigen presenting cells, the polypeptides of interest are proteolytically processed within the antigen presenting cells, and peptide fragments of the polypeptides are presented on MHC molecules expressed in the antigen presenting cells. The identity of the polypeptide that stimulates a human lymphocyte in an assay described herein can be determined from examination of the set of library cells that were provided to the antigen presenting cells that produced the stimulation. In some embodiments, it is useful to map the epitope within the polypeptide that is bound by MHC molecules to produce the observed stimulation. This epitope, or the longer polypeptide from which it is derived (both of which are referred to as an "antigen" herein) can form the basis for an immunogenic composition, or for an antigenic stimulus in future antigen presentation assays.

Methods for identifying peptides bound by MHC molecules are known. In some embodiments, epitopes are identified by generating deletion mutants of the polypeptide of interest and testing these for the ability to stimulate lymphocytes. Deletions that lose the ability to stimulate lymphocytes, when processed and presented by antigen presenting cells, have lost the peptide epitope. In some embodiments, epitopes are identified by synthesizing peptides corresponding to portions of the polypeptide of interest and testing the peptides for the ability to stimulate lymphocytes (e.g., in antigen presentation assays in which antigen presenting cells are pulsed with the peptides). Other methods for identifying MHC bound peptides involve lysis of the antigen presenting cells that include the antigenic peptide, affinity purification of the MHC molecules from cell lysates, and subsequent elution and analysis of peptides from the MHC (Falk, K. et al. Nature 351:290, 1991, and U.S. Pat. No. 5,989,565).

In other embodiments, it is useful to identify the clonal T cell receptors that have been expanded in response to the antigen. Clonal T cell receptors are identified by DNA sequencing of the T cell receptor repertoire (Howie et al, 2015 *Sci Trans Med* 7:301). By identifying TCR specificity and function, TCRs can be transfected into other cell types and used in functional studies or for novel immunotherapies. In other embodiments, it is useful to identify and isolate T cells responsive to a tumor antigen in a subject. The isolated T cells can be expanded ex vivo and administered to a subject for cancer therapy or prophylaxis.

Methods of Identifying Immune Responses of a Subject

The disclosure provides methods of identifying one or more immune responses of a subject (e.g., a test subject, or a target subject). In some embodiments, one or more immune responses of a subject (e.g., a test subject or a target subject) are determined by a) providing a library described herein that includes a panel of tumor antigens (e.g., known tumor antigens, tumor antigens described herein, or tumor antigens, potential tumor antigens, and/or other polypeptides of interest identified using a method described herein); b) contacting the library with antigen presenting cells from the subject; c) contacting the antigen presenting cells with lymphocytes from the subject; and d) determining whether one or more lymphocytes are stimulated by, inhibited and/or suppressed by, activated by, or non-responsive to one or more tumor antigens presented by one or more antigen presenting cells. In some embodiments, the library includes about 1, 3, 5, 10, 15, 20, 25, 30, 40, 50, 60, 70, 80, 90, 100, or more tumor antigens.

In some embodiments, a test subject is (i) a cancer subject who has not received a cancer therapy; (ii) a cancer subject who has not responded and/or is not responding and/or has responded negatively, clinically to a cancer therapy; or (iii) a subject who has not been diagnosed with a cancer.

In some embodiments, a target subject is (i) a cancer subject who responds or has responded positively clinically ("responsive subject") to a cancer therapy; (ii) a cancer subject who has not responded and/or is not responding and/or has responded negatively, clinically ("non-responsive subject") to a cancer therapy; (iii) a cancer subject who responds or has responded spontaneously to a cancer ("spontaneous target subject"); or (vi) a subject who has not been diagnosed with a cancer ("normal subject").

In some embodiments, lymphocyte stimulation, non-stimulation, inhibition and/or suppression, activation, and/or non-responsiveness is determined by assessing levels of one or more expressed or secreted cytokines or other immune mediators described herein. In some embodiments, levels of one or more expressed or secreted cytokines that is at least 20%, 40%, 60%, 80%, 100%, 120%, 140%, 160%, 180%, 200% or more, higher than a control level indicates lymphocyte stimulation. In some embodiments, a level of one or more expressed or secreted cytokines that is at least 1, 2, 3, 4 or 5 standard deviations greater than the mean of a control level indicates lymphocyte stimulation. In some embodiments, a level of one or more expressed or secreted cytokines that is at least 1, 2, 3, 4 or 5 median absolute deviations (MADs) greater than a median response level to a control indicates lymphocyte stimulation. In some embodiments, a control is a negative control, for example, a clone expressing Neon Green (NG). In some embodiments, a level of one or more expressed or secreted cytokines that is at least 20%, 40%, 60%, 80%, 100%, 120%, 140%, 160%, 180%, 200% or more, lower than a control level indicates lymphocyte inhibition and/or suppression. In some embodiments, a level of one or more expressed or secreted cytokines that is at least 1, 2, 3, 4 or 5 standard deviations lower than the mean of a control level indicates lymphocyte inhibition and/or suppression. In some embodiments, a level of one or more expressed or secreted cytokines that is at least 1, 2, 3 or 4 or 5 median absolute deviations (MADs) lower than a median response level to a control indicates lymphocyte inhibition and/or suppression. In some embodiments, a control is a negative control, for example, a clone expressing Neon Green (NG). In some embodiments, levels of one or more expressed or secreted cytokines that is at least 20%, 40%, 60%, 80%, 100%, 120%, 140%, 160%, 180%, 200% or more, higher or lower than a control level indicates lymphocyte activation. In some embodiments, a level of one or more expressed or secreted cytokines that is at least 1, 2, 3, 4 or 5 standard deviations greater or lower than the mean of a control level indicates lymphocyte activation. In some embodiments, a level of one or more expressed or secreted cytokines that is at least 1, 2, 3, 4 or 5 median absolute deviations (MADs) greater or lower than a median response level to a control indicates lymphocyte activation. In some embodiments, a control is a negative control, for example, a clone expressing Neon Green (NG). In some embodiments, a level of one or more expressed or secreted cytokines that is within about 20%, 15%, 10%, 5%, or less, of a control level indicates lymphocyte non-responsiveness or non-stimulation. In some embodiments, a level of one or more expressed or secreted cytokines that is less than 1 or 2 standard deviations higher or lower than the mean of a control level indicates lymphocyte non-responsiveness or non-stimulation. In some embodiments, a level of one or more expressed or secreted cytokines that is less than 1 or 2 median absolute deviations (MADs) higher or lower than a median response level to a control indicates lymphocyte non-responsiveness or non-stimulation. In some embodiments, a subject response profile can include a quantification, identification, and/or representation of a panel of different cytokines (e.g., 1, 2, 3, 4, 5, 6, 7, 8, 9, 10, 12, 14, 16, 18, 20, or more cytokines) and of the total number of tumor antigens (e.g., of all or a portion of different tumor antigens from the library) that stimulate, do not stimulate, inhibit and/or suppress, activate, or have no or minimal effect on production, expression or secretion of each member of the panel of cytokines.

Method of Obtaining a Subject Response Profile

The disclosure provides methods for obtaining a subject response profile from a test subject (a "subject response profile").

In some embodiments, the subject response profile of a test subject is obtained by a) providing a library described herein that includes a panel of tumor antigens (e.g., known tumor antigens, tumor antigens described herein, or tumor antigens, potential tumor antigens, and/or other polypeptides of interest identified using a method described herein); b) contacting the library with antigen presenting cells from the test subject; c) contacting the antigen presenting cells with lymphocytes from the test subject; and d) determining whether one or more lymphocytes are stimulated by, inhibited and/or suppressed by, activated by, or non-responsive to one or more tumor antigens presented by one or more antigen presenting cells, to obtain the subject response profile. In some embodiments, the library includes about 1, 3, 5, 10, 15, 20, 25, 30, 40, 50, 60, 70, 80, 90, 100, 150, 200, 250, 500, 1000, or more tumor antigens.

The subject response profile can include a quantification, identification, and/or representation of all or a portion of the panel of tumor antigens, identified by the methods of the disclosure, that stimulate lymphocytes, that do not stimulate lymphocytes, that inhibit and/or suppress lymphocytes, that activate lymphocytes, or to which lymphocytes are non-responsive. In some embodiments, the subject response profile further includes a quantification, identification, and/or representation of the level of expression or secretion of one or more immune mediators, e.g., one or more cytokines.

In some embodiments, the subject response profile includes a quantification, identification, and/or representation of all or a portion of the panel of tumor antigens, identified by the methods of the disclosure, that stimulate expression or secretion of one or more immune mediators, that inhibit and/or suppress expression or secretion of one or more immune mediators, and/or which do not, or minimally, affect expression or secretion of immune mediators. In some embodiments, the subject response profile further includes a quantification, identification, and/or representation of the level of expression or secretion of one or more immune mediators, e.g., one or more cytokines.

Methods of Obtaining a Target Response Profile

In some embodiments, a subject response profile is compared to a corresponding response profile from a target subject, e.g. a cancer subject who responds and/or has responded clinically to a cancer therapy; a cancer subject who does not and/or has not responded clinically to a cancer therapy; a subject who has, or has had, spontaneous response to a cancer; or a subject who has not been diagnosed with a cancer (a "target response profile" of a target subject).

The disclosure provides methods for obtaining a target response profile from a target subject. The target response profile of a target subject is obtained by a) providing a library described herein that includes all or a portion of the same panel of tumor antigens (e.g., known tumor antigens, tumor antigens described herein, or tumor antigens, potential tumor antigens, and/or other polypeptides of interest identified using a method described herein) used to generate the subject response profile; b) contacting the library with antigen presenting cells from the target subject; c) contacting the antigen presenting cells with lymphocytes from the target subject; and d) determining whether one or more lymphocytes are stimulated by, inhibited and/or suppressed by, activated by, or non-responsive to, one or more tumor antigens presented by one or more antigen presenting cells, to obtain the target response profile.

The target response profile includes a quantification, identification, and/or representation of the immune response of cells from the target subject to the same panel of tumor antigens included in the subject response profile.

In some embodiments, the target response profile includes a quantification, identification, and/or representation of all or a portion of the panel of tumor antigens that stimulate lymphocytes, that do not stimulate lymphocytes, that inhibit and/or suppress lymphocytes, that activate lymphocytes, and/or to which lymphocytes are non-responsive. In some embodiments, the subject response profile further includes a quantification, identification, and/or representation of the level of expression or secretion of one or more immune mediators, e.g., one or more cytokines.

In some embodiments, the target response profile includes a quantification, identification, and/or representation of all or a portion of the panel of tumor antigens identified by the methods of the disclosure, that stimulate expression and/or secretion of one or more immune mediators, that inhibit and/or suppress expression or secretion of one or more immune mediators, and/or which do not, or minimally, affect expression and/or secretion of immune mediators. In some embodiments, the subject response profile further includes a quantification, identification, and/or representation of the level of expression or secretion of one or more immune mediators, e.g., one or more cytokines.

Comparison of a Subject Response Profile to a Target Response Profile

Lymphocytes

In some embodiments, a subject response profile is similar to the target response profile if the identified tumor antigens that stimulate lymphocytes in the subject response profile differ by no more than 1, 2, 3, 4, 5, 10, 15, 20, or 25 from the identified tumor antigens that stimulate lymphocytes in the target response profile; if the identified tumor antigens that do not stimulate lymphocytes in the subject response profile differ by no more than 1, 2, 3, 4, 5, 10, 15, 20, or 25 from the identified tumor antigens that do not stimulate lymphocytes in the target response profile; if the identified tumor antigens that inhibit and/or suppress lymphocytes in the subject response profile differ by no more than 1, 2, 3, 4, 5, 10, 15, 20, or 25 from the identified tumor antigens that inhibit and/or suppress lymphocytes in the target response profile; if the identified tumor antigens that activate lymphocytes in the subject response profile differ by no more than 1, 2, 3, 4, 5, 10, 15, 20, or 25 from the identified tumor antigens that activate lymphocytes in the target response profile; and/or if the identified tumor antigens that do not stimulate lymphocytes or to which lymphocytes are non-responsive in the subject response profile differ by no more than 1, 2, 3, 4, 5, 10, 15, 20, or 25 from the identified tumor antigens to which lymphocytes are not, or are minimally, responsive in the target response profile.

In some embodiments, a subject response profile is dissimilar from the target response profile if the identified tumor antigens that stimulate lymphocytes in the subject response profile differ by more than 5, 6, 7, 8, 9, 10, 20, or more, from the identified tumor antigens that stimulate lymphocytes in the target response profile; if the identified tumor antigens that do not stimulate lymphocytes in the subject response profile differ by more than 5, 6, 7, 8, 9, 10, 20, or more, from the identified tumor antigens that do not stimulate lymphocytes in the target response profile; if the identified tumor antigens that inhibit and/or suppress lymphocytes in the subject response profile differ by more than 5, 6, 7, 8, 9, 10, 20, or more, from the identified tumor antigens that inhibit and/or suppress lymphocytes in the target response profile; if the identified tumor antigens that activate lymphocytes in the subject response profile differ by more than 5, 6, 7, 8, 9, 10, 20, or more, from the identified tumor antigens that activate lymphocytes in the target response profile; and/or if the identified tumor antigens that do not stimulate lymphocytes or to which lymphocytes are non-responsive in the subject response profile differ by more than 5, 6, 7, 8, 9, 10, 20, or more, from the identified tumor antigens to which lymphocytes are not, or are minimally, responsive in the target response profile.

In some embodiments, a subject response profile is similar to the target response profile if the identified tumor antigens that stimulate lymphocytes in the subject response profile differ by no more than 1%, 2%, 3%, 4%, 5%, 10%, 15%, 20%, or 25% from the identified tumor antigens that stimulate lymphocytes in the target response profile; if the identified tumor antigens that do not stimulate lymphocytes in the subject response profile differ by no more than 1%, 2%, 3%, 4%, 5%, 10%, 15%, 20%, or 25% from the identified tumor antigens that do not stimulate lymphocytes in the target response profile; if the identified tumor antigens that inhibit and/or suppress lymphocytes in the subject response profile differ by no more than 1%, 2%, 3%, 4%, 5%, 10%, 15%, 20%, or 25% from the identified tumor antigens that inhibit and/or suppress lymphocytes in the target response profile; if the identified tumor antigens that activate lymphocytes in the subject response profile differ by no more than 1%, 2%, 3%, 4%, 5%, 10%, 15%, 20%, or 25% from the identified tumor antigens that activate lymphocytes in the target response profile; and/or if the identified tumor antigens that do not stimulate lymphocytes or to which lymphocytes are non-responsive in the subject response profile differ by no more than 1%, 2%, 3%, 4%, 5%, 10%, 15%, 20%, or 25% from the identified tumor antigens to which lymphocytes are not, or are minimally, responsive in the target response profile.

In some embodiments, a subject response profile is dissimilar from the target response profile if the identified tumor antigens that stimulate lymphocytes in the subject response profile differ by more than 5%, 6%, 7%, 8%, 9%, 10%, 20%, or more, from the identified tumor antigens that stimulate lymphocytes in the target response profile if the identified tumor antigens that do not stimulate lymphocytes in the subject response profile differ by more than 5%, 6%, 7%, 8%, 9%, 10%, 20%, or more, from the identified tumor antigens that do not stimulate lymphocytes in the target response profile; and/or if the identified tumor antigens that inhibit and/or suppress lymphocytes in the subject response profile differ by more than 5%, 6%, 7%, 8%, 9%, 10%, 20%, or more, from the identified tumor antigens that inhibit and/or suppress lymphocytes in the target response profile;

if the identified tumor antigens that activate lymphocytes in the subject response profile differ by more than 5%, 6%, 7%, 8%, 9%, 10%, 20%, or more, from the identified tumor antigens that activate lymphocytes in the target response profile; and/or if the identified tumor antigens that do not stimulate lymphocytes or to which lymphocytes are non-responsive in the subject response profile differ by more than 5%, 6%, 7%, 8%, 9%, 10%, 20%, or more, from the identified tumor antigens to which lymphocytes are not, or are minimally, responsive in the target response profile.

Cytokines

In some embodiments, the target response profile can include a quantification, identification, and/or representation of one or more cytokines and the total number of tumor antigens (e.g., of the same tumor antigens included in the subject response profile) that stimulate, do not stimulate, inhibit and/or suppress, or have no or minimal effect on cytokine production, expression and/or secretion. In some embodiments, the target response profile can include a quantification, identification, and/or representation of a panel of different cytokines (e.g., 1, 2, 3, 4, 5, 6, 7, 8, 9, 10, 12, 14, 16, 18, 20, or more (e.g., all) of the cytokines included in the subject response profile) and the total number of tumor antigens (e.g., of the same tumor antigens included in the subject response profile) that stimulate, do not stimulate, inhibit and/or suppress, or have no or minimal effect on production, expression and/or secretion of the panel of cytokines.

In some embodiments, a subject response profile is similar to the target response profile if the total number of antigens that stimulate expression and/or secretion of one or more cytokines included in the subject response profile differs by no more than 1, 2, 3, 4, 5, 10, 15, 20, or 25 from the total number of antigens that stimulate the same one or more cytokines included in the target response profile; if the total number of antigens that do not stimulate expression and/or secretion of one or more cytokines included in the subject response profile differs by no more than 1, 2, 3, 4, 5, 10, 15, 20, or 25 from the total number of antigens that do not stimulate the same one or more cytokines included in the target response profile; if the total number of antigens that inhibit and/or suppress one or more cytokines included in the subject response profile differs by no more than 1, 2, 3, 4, 5, 10, 15, 20, or 25 from the total number of antigens that inhibit and/or suppress expression and/or secretion of the same one or more cytokines included in the target response profile; and/or if the total number of antigens that have no or minimal effect on expression and/or secretion of one or more cytokines included in the subject response profile differs by no more than 1, 2, 3, 4, 5, 10, 15, 20, or 25 from the total number of antigens that that have no or minimal effect on the same one or more cytokines included in the target response profile.

In some embodiments, a subject response profile is dissimilar from the target response profile if the total number of antigens that stimulate expression and/or secretion of one or more cytokines included in the subject response profile differs by more than 5, 6, 7, 8, 9, 10, 20, or more, from the total number of antigens that stimulate the same one or more cytokines included in the target response profile; if the total number of antigens that do not stimulate expression and/or secretion of one or more cytokines included in the subject response profile differs by more than 5, 6, 7, 8, 9, 10, 20, or more, from the total number of antigens that do not stimulate the same one or more cytokines included in the target response profile; if the total number of antigens that inhibit and/or suppress expression and/or secretion of one or more cytokines included in the subject response profile differs by more than 5, 6, 7, 8, 9, 10, 20, or more, from the total number of antigens that inhibit and/or suppress the same one or more cytokines included in the target response profile; and/or if the total number of antigens that have no or minimal effect on expression and/or secretion of one or more cytokines included in the subject response profile differs by more than 5, 6, 7, 8, 9, 10, 20, or more, from the total number of antigens that that have no or minimal effect on the same one or more cytokines included in the target response profile.

The foregoing methods apply to subject response profiles and target response profiles obtained with libraries encoding polypeptides that are potential tumor antigens, as well as tumor antigens.

Methods of Identifying/Selecting Subjects for Cancer Therapy

The disclosure provides methods of identifying a test subject, e.g., a cancer subject, for initiation, continuation, modification, and/or discontinuation or in some cases non-initiation of a cancer therapy (e.g., a cancer therapy described herein). Generally, such methods include comparing one or more immune responses of a cancer subject who has not received a cancer therapy (or who has not responded and/or is not responding and/or has responded negatively, clinically to a cancer therapy) to one or more immune responses of a target subject, who may be: (i) a cancer subject who responds or has responded positively clinically ("responsive subject") to the cancer therapy; (ii) a cancer subject who has not responded and/or is not responding and/or has responded negatively, clinically ("non-responsive subject") to the cancer therapy; (iii) a cancer subject who responds or has responded spontaneously to a cancer ("spontaneous subject"); and/or (vi) a subject who has not been diagnosed with a cancer ("normal subject").

One or more immune responses of the test subject that are the same or similar to one or more immune responses of a responsive subject and/or dissimilar to one or more immune responses of a non-responsive subject indicates that the test subject should initiate and/or continue and/or modify (e.g., increase and/or combine with one or more other modalities) the cancer therapy. One or more immune responses of the test subject that are dissimilar to one or more immune responses of a responsive subject and/or similar to (or same as) one or more immune responses of a non-responsive subject indicates that the cancer subject should not initiate and/or should discontinue and/or should modify (e.g., reduce and/or combine with one or more other modalities) the cancer therapy, and/or should initiate an alternative cancer therapy, or in some cases, no cancer therapy.

In some embodiments, a subject response profile that is similar to a target response profile (of a responsive subject) indicates the test subject should initiate and/or continue and/or modify (e.g., increase and/or combine with one or more other modalities) the cancer therapy. In some embodiments, methods described herein include selecting a test subject for initiation and/or continuation and/or modification (e.g., increase and/or combine with one or more other modalities) of the cancer therapy if the subject response profile is similar to a target response profile (of a responsive subject). In some embodiments, methods described herein include initiating and/or continuing and/or modifying (e.g., increasing and/or combining with one or more other modalities) administration of the cancer therapy to a test subject if the subject response profile is similar to a target response profile (of a responsive subject). In some embodiments, methods described herein include administering the cancer therapy to a test subject if the subject response profile is similar to a target response profile (of a responsive subject). In some embodiments, methods described herein include modifying (e.g., increasing and/or combining with one or more other modalities) administration of the cancer therapy to a test subject if the subject response profile is similar to a target response profile (of a responsive subject).

In some embodiments, a subject response profile that is dissimilar to a target response profile (of a responsive subject) indicates the test subject should not initiate and/or should modify (e.g., reduce and/or combine with one or more other modalities) and/or should discontinue the cancer therapy, and/or should initiate an alternative cancer therapy. In some embodiments, methods described herein include not selecting a test subject for initiation and/or selecting a test subject for modification (e.g., reduction and/or combination with one or more other modalities) and/or discontinuation of the cancer therapy and/or initiation of an alternative cancer therapy, if the subject response profile is dissimilar to a target response profile (of a responsive subject). In some embodiments, methods described herein include not initiating and/or modifying (e.g., reducing and/or combining with one or more other modalities) and/or discontinuing administration of the cancer therapy to a test subject and/or initiation of an alternative cancer therapy, if the subject response profile is dissimilar to a target response profile (of a responsive subject). In some embodiments, methods described herein include not administering the cancer therapy to a test subject if the subject response profile is dissimilar to a target response profile (of a responsive subject). In some embodiments, methods described herein include modifying (e.g., reducing and/or combining with one or more other modalities) administration of the cancer therapy to a test subject if the subject response profile is dissimilar to a target response profile (of a responsive subject). In some embodiments, methods described herein include administering an alternative cancer therapy to a test subject if the subject response profile is dissimilar to a target response profile (of a responsive subject).

In some embodiments, a subject response profile is compared to a corresponding response profile from a cancer subject who has not responded and/or is not responding and/or responds negatively, clinically to the cancer therapy (a "target response profile" of a non-responsive subject). In some embodiments, the target response profile (of a nonresponsive subject) is obtained by providing a library described herein that includes all or a portion of the same panel of tumor antigens (e.g., known tumor antigens, tumor antigens described herein or identified using a method described herein) used to generate the subject response profile; contacting the library with antigen presenting cells from the non-responsive subject; contacting the antigen presenting cells with lymphocytes from the non-responsive subject; and determining whether one or more lymphocytes are stimulated, inhibited and/or suppressed by, or non-responsive to, one or more tumor antigens presented by one or more antigen presenting cells. The target response profile (of a non-responsive subject) includes a quantification, identification, and/or representation of the immune response of cells from the non-responsive cancer subject to the same panel of tumor antigens included in the subject response profile.

Methods for comparing a subject response profile to a target response profile, and parameters for determining similarity and dissimilarly of a subject response profile to a target response profile are provided in the disclosure.

In some embodiments, the target response profile (of a non-responsive subject) includes a quantification, identification, and/or representation of all or a portion of the panel of tumor antigens that stimulate lymphocytes, that do not stimulate lymphocytes, and/or that inhibit and/or suppress lymphocytes. In some embodiments, a subject response profile is similar to the target response profile (of a nonresponsive subject) if the identified tumor antigens that stimulate lymphocytes in the subject response profile differ by no more than 1, 2, 3, 4, 5, 10, 15, 20, or 25 from the identified tumor antigens that stimulate lymphocytes in the target response profile (of a nonresponsive subject); if the identified tumor antigens that do not stimulate lymphocytes in the subject response profile differ by no more than 1, 2, 3, 4, 5, 10, 15, 20, or 25 from the identified tumor antigens that do not stimulate lymphocytes in the target response profile (of a nonresponsive subject); and/or if the identified tumor antigens that inhibit and/or suppress lymphocytes in the subject response profile differ by no more than 1, 2, 3, 4, 5, 10, 15, 20, or 25 from the identified tumor antigens that inhibit and/or suppress lymphocytes in the target response profile (of a nonresponsive subject). In some embodiments, a subject response profile is dissimilar from the target response profile if the identified tumor antigens that stimulate lymphocytes in the subject response profile differ by more than 5, 6, 7, 8, 9, 10, 20, or more, from the identified tumor antigens that stimulate lymphocytes in the target response profile (of a nonresponsive subject); if the identified tumor antigens that do not stimulate lymphocytes in the subject response profile differ by more than 5, 6, 7, 8, 9, 10, 20, or more, from the identified tumor antigens that do not stimulate lymphocytes in the target response profile (of a nonresponsive subject); and/or if the identified tumor antigens that inhibit and/or suppress lymphocytes in the subject response profile differ by more than 5, 6, 7, 8, 9, 10, 20, or more, from the identified tumor antigens that inhibit and/or suppress lymphocytes in the target response profile (of a nonresponsive subject). In some embodiments, a subject response profile is similar to the target response profile (of a nonresponsive subject) if the identified tumor antigens that stimulate lymphocytes in the subject response profile differ by no more than 1%, 2%, 3%, 4%, 5%, 10%, 15%, 20%, or 25% from the identified tumor antigens that stimulate lymphocytes in the target response profile (of a nonresponsive subject); if the identified tumor antigens that do not stimulate lymphocytes in the subject response profile differ by no more than 1%, 2%, 3%, 4%, 5%, 10%, 15%, 20%, or 25% from the identified tumor antigens that do not stimulate lymphocytesin the target response profile (of a nonresponsive subject); and/or if the identified tumor antigens that inhibit and/or suppress lymphocytes in the subject response profile differ by no more than 1%, 2%, 3%, 4%, 5%, 10%, 15%, 20%, or 25% from the identified tumor antigens that inhibit and/or suppress lymphocytes in the target response profile (of a non-responsive subject). In some embodiments, a subject response profile is dissimilar from the target response profile (of a non-responsive subject) if the identified tumor antigens that stimulate lymphocytes in the subject response profile differ by more than 5%, 6%, 7%, 8%, 9%, 10%, 20%, or more, from the identified tumor antigens that stimulate lymphocytes in the target response profile (of a non-responsive subject); if the identified tumor antigens that do not stimulate lymphocytes in the subject response profile differ by more than 5%, 6%, 7%, 8%, 9%, 10%, 20%, or more, from the identified tumor antigens that do not stimulate lymphocytes in the target response profile (of a nonresponsive subject); and/or if the identified tumor antigens that inhibit and/or suppress lymphocytes in the subject response profile differ by more than 5%, 6%, 7%, 8%, 9%, 10%, 20%, or more, from the identified tumor antigens that inhibit and/or suppress lymphocytes in the target response profile (of a non-responsive subject).

In some embodiments, the target response profile (of a non-responsive subject) can include a quantification, identification, and/or representation of one or more cytokines and the total number of tumor antigens (e.g., of the same tumor antigens included in the subject response profile) that stimulate, do not stimulate, and/or inhibit and/or suppress cytokine production, expression and/or secretion. In some embodiments, the target response profile (of a nonresponsive subject) can include a quantification, identification, and/or representation of a panel of different cytokines (e.g., 1, 2, 3, 4, 5, 6, 7, 8, 9, 10, 12, 14, 16, 18, 20, or more (e.g., all), of the cytokines included in the subject response profile) and the total number of tumor antigens (e.g., of the same tumor antigens included in the subject response profile) that stimulate, do not stimulate, and/or inhibit and/or suppress production, expression and/or secretion of the panel of cytokines. In some embodiments, a subject response profile is similar to the target response profile (of a nonresponsive subject) if the total number of antigens that stimulate one or more cytokines included in the subject response profile differs by no more than 1, 2, 3, 4, 5, 10, 15, 20, or 25 from the total number of antigens that stimulate the same one or more cytokines included in the target response profile (of a non-responsive subject); if the total number of antigens that do not stimulate one or more cytokines included in the subject response profile differs by no more than 1, 2, 3, 4, 5, 10, 15, 20, or 25 from the total number of antigens that do not stimulate the same one or more cytokines included in the target response profile (of a nonresponsive subject); and/or if the total number of antigens that inhibit and/or suppress one or more cytokines included in the subject response profile differs by no more than 1, 2, 3, 4, 5, 10, 15, 20, or 25 from the total number of antigens that inhibit and/or suppress the same one or more cytokines included in the target response profile (of a non-responsive subject). In some embodiments, a subject response profile is dissimilar from the target response profile (of a non-responsive subject) if the total number of antigens that stimulate one or more cytokines included in the subject response profile differs by more than 5, 6, 7, 8, 9, 10, or more, from the total number of antigens that stimulate the same one or more cytokines included in the target response profile (of a non-responsive subject); if the total number of antigens that not stimulate one or more cytokines included in the subject response profile differs by more than 5, 6, 7, 8, 9, 10, or more, from the total number of antigens that do not stimulate the same one or more cytokines included in the target response profile (of a non-responsive subject); and/or if the total number of antigens that inhibit and/or suppress one or more cytokines included in the subject response profile differs by more than 5, 6, 7, 8, 9, 10, 20, or more, from the total number of antigens that inhibit and/or suppress the same one or more cytokines included in the target response profile (of a non-responsive subject).

In some embodiments, a subject response profile that is dissimilar to a target response profile (of a non-responsive subject) indicates the test subject should initiate and/or continue and/or modify (e.g., increase and/or combine with one or more other modalities) the cancer therapy. In some embodiments, methods described herein include selecting a test subject for initiation and/or continuation and/or modification of (e.g., increasing and/or combining with one or more other modalities) the cancer therapy if the subject response profile is dissimilar to a target response profile (of a non-responsive subject). In some embodiments, methods described herein include initiating and/or continuing and/or modifying (e.g., increasing and/or combining with one or more other modalities) administration of the cancer therapy to a test subject if the subject response profile is dissimilar to a target response profile (of a non-responsive subject). In some embodiments, methods described herein include administering the cancer therapy to a test subject if the subject response profile is dissimilar to a target response profile (of a non-responsive subject). In some embodiments, methods described herein include modifying (e.g., increasing and/or combining with one or more other modalities) administration of the cancer therapy to a test subject if the subject response profile is dissimilar to a target response profile (of a non-responsive subject).

In some embodiments, a subject response profile that is similar to a target response profile (of a non-responsive subject) indicates the test subject should not initiate, and/or should modify (e.g., reduce and/or combine with one or more other modalities), and/or should discontinue the cancer therapy, and/or should initiate an alternative cancer therapy. In some embodiments, methods described herein include not selecting a test subject for initiation and/or selecting a test subject for modification (e.g., reduction and/or combination with one or more other modalities) and/or discontinuation of the cancer therapy and/or initiation of an alternative cancer therapy, if the subject response profile is similar to a target response profile (of a non-responsive subject). In some embodiments, methods described herein include not initiating and/or modifying (e.g., reducing and/or combining with one or more other modalities) and/or discontinuing administration of the cancer therapy to a test subject and/or initiating an alternative cancer therapy, if the subject response profile is similar to a target response profile (of a non-responsive subject). In some embodiments, methods described herein include not administering the cancer therapy to a test subject if the subject response profile is similar to a target response profile (of a non-responsive subject). In some embodiments, methods described herein include modifying (e.g., reducing and/or combining with one or more other modalities) administration of the cancer therapy to a test subject if the subject response profile is similar to a target response profile (of a non-responsive subject). In some embodiments, methods described herein include administering an alternative cancer therapy to a test subject if the subject response profile is similar to a target response profile (of a non-responsive subject).

In some embodiments, a subject response profile described herein is compared to one or more (e.g., 1, 2, 3, 4, 5, 6, 7, 8, 9, 10, or more) target response profiles of one or more responsive subjects and/or of one or more (e.g., 1, 2, 3, 4, 5, 6, 7, 8, 9, 10, or more) non-responsive subjects. In some embodiments, a target response profile described herein (e.g., of a responsive subject or non-responsive subject) includes an average of one or more immune responses (described herein) from a population of responsive or non-responsive subjects, respectively. In some embodiments, one or more (e.g., 1, 2, 3, 4, 5, 6, 7, 8, 9, 10, or more) subject response profiles of the test subject are obtained (e.g., before, during, and/or after initiation, modification, and/or discontinuation of administration of the cancer therapy).

Methods of Selecting Tumor Antigens and Methods of Inducing an Immune Response in a Subject In general, immune responses can be usefully defined in terms of their integrated, functional end-effects. Dhabar et al. (2014) have proposed that immune responses can be categorized as being immunoprotective, immunopathological, and immunoregulatory/inhibitory. While these categories provide useful constructs with which to organize ideas, an overall in vivo immune response is likely to consist of several types of responses with varying amounts of dominance from each category. Immunoprotective or beneficial responses are defined as responses that promote efficient wound healing, eliminate infections and cancer, and mediate vaccine-induced immunological memory. These responses are associated with cytokines and mediators such as IFN-gamma, IL-12, IL-2, Granzyme B, CD107, etc. Immunopathological or deleterious responses are defined as those that are directed against self (autoimmune disease like multiple sclerosis, arthritis, lupus) or innocuous antigens (asthma, allergies) and responses involving chronic, non-resolving inflammation. These responses can also be associated with molecules that are implicated in immunoprotective responses, but also include immune mediators such as TNF-alpha, IL-10, IL-13, IL-17, IL-4, IgE, histamine, etc. Immunoregulatory responses are defined as those that involve immune cells and factors that regulate (mostly down-regulate) the function of other immune cells. Recent studies suggest that there is an arm of the immune system that functions to inhibit immune responses. For example, regulatory CD4$^+$CD25+FoxP3$^+$ T cells, IL-10, and TGF-beta, among others have been shown to have immunoregulatory/inhibitory functions. The physiological function of these factors is to keep pro-inflammatory, allergic, and autoimmune responses in check, but they may also suppress anti-tumor immunity and be indicative of negative prognosis for cancer. In the context of tumors, the expression of co-stimulatory molecules often decreases, and the expression of co-inhibitory ligands increases. MHC molecules are often down-regulated on tumor cells, favoring their escape. The tumor micro-environment, including stromal cells, tumor associated immune cells, and other cell types, produce many inhibitory factors, such as, IL-10, TGF-β, and IDO. Inhibitory immune cells, including T regs, Tr1 cells, immature DCs (iDCs), pDCs, and MDSC can be found in the tumor microenvironment. (Y Li UT GSBS Thesis 2016). Examples of mediators and their immune effects are shown in Table 2.

TABLE 2

Immune Mediators

| Cytokine | Function | Secreted by | Beneficial Outcomes | | | Deleterious Outcomes | | |
|---|---|---|---|---|---|---|---|---|
| | | | Cancer | ID | AI | Cancer | ID | AI |
| TRAIL | Induces apoptosis of tumor cells, induces immune suppressor cells | Most cells | X | X | ? | X | ? | ? |
| IFN-gamma | Critical for innate and adaptive immunity to pathogens, inhibits viral replication, increases MHC Class I expression | T cells, NK cells, NKT cells | X | X | ? | X | ? | X |
| IL-12 | Th1 differentiation; stimulates T cell growth, induces IFN-gamma/TNF-alpha secretion from T cells, enhances CTLs | DCs, macrophages, neutrophils | X | X | ? | X | ? | X |
| IL-2 | T cell proliferation, differentiation into effector and memory T cells and regulatory T cells | T cells, APCs | X | X | X | ? | ? | ? |
| TNF-alpha | Induces fevers, apoptosis, inflammation, inhibits viral replication | Macrophages, APCs | X | X | ? | X | ? | X |
| MIP-1 alpha | Chemotactic/pro-inflammatory effects, activates granulocytes, induces secretion of IL-1/IL6/TNF-alpha | Macrophages, DCs, T cells | X | X | ? | ? | ? | X |
| MIP-1 beta | Chemotactic/pro-inflammatory effects, activates granulocytes, induces secretion of IL-1/IL6/ TNF-alpha | Macrophages, DCs, T cells | X | X | ? | ? | ? | X |
| CXCL9 | T cell chemoattractant, induced by IFN-gamma | APCs | X | X | ? | X | ? | X |
| CXCL10 | Chemoattractant for T cells, macrophages, NK | APCs | X | X | ? | ? | ? | X |

TABLE 2-continued

| | | Immune Mediators | Beneficial Outcomes | | | Deleterious Outcomes | | |
|---|---|---|---|---|---|---|---|---|
| Cytokine | Function | Secreted by | Cancer | ID | AI | Cancer | ID | AI |
| | and DCs, promotes T cell adhesion to endothelial cells | | | | | | | |
| MCP-1 | Recruits monocytes, memory T cells and DCS | most cells | X | X | ? | X | ? | X |
| RANTES | Recruits T cells, eosinophils, basophils, induces proliferation/activation of NK cells, T cell activation marker | T cells | X | X | ? | ? | ? | X |
| CXCL11 | Chemoattractant for activated T cells | APCs | X | X | ? | ? | ? | X |
| IL-3 | Stimulates proliferation of myeloid cells, induces growth of T cells | T cells, APCs | X | X | ? | ? | ? | ? |
| IL-17 I | Produced by Th17 cells, induces production of IL6, GCSF, GMCSF, IL1b, TGF-beta, TNF-alpha, chemokines | T cells | X | X | ? | X | ? | X |
| IL-18 | Pro-inflammatory, induces cell-mediated immunity, production of IFN-gamma | Macrophages | X | X | ? | X | ? | X |
| IL-21 | Induces proliferation, upregulated in Th2/Th17 TFh | CD4 T cells | X | X | X | X | ? | ? |
| IL-22 | Cell-mediated immunity, pro-inflammatory | NK cells, T cells | X | X | ? | X | ? | X |
| IL-23 | Pro-inflammatory | APCs | X | X | ? | X | ? | X |
| IL-24 | Controls survival and proliferation | Monocytes-macrophages, Th2 cells | X | X | ? | ? | ? | X |
| IL-27 | Induces differentiation of T cells, upregulates IL-10, can be pro-or anti-inflammatory; promotes Th1/Tr1, inhibits Th2/Th17/regulatory T cells | APCs, T cells | X | X | X | X | ? | X |
| IL-32 | Pro-inflammatory, increases secretion of inflammatory cytokines and chemokines | T cells, NK cells | X | X | ? | X | ? | X |
| CSF | Induces myeloid cells to proliferate and differentiate | APCs | X | X | X | ? | ? | ? |
| GM-CSF | Promotes macrophage and Eosinophil proliferation and maturation, growth factor | T cells, macrophages | X | X | ? | ? | ? | X |
| TRANCE | Helps DC maturation/survival, T cell activation marker, anti-apoptotic, stimulates osteoclast activity | T cells | ? | X | ? | X | ? | ? |

TABLE 2-continued

Immune Mediators

| Cytokine | Function | Secreted by | Beneficial Outcomes | | | Deleterious Outcomes | | |
|---|---|---|---|---|---|---|---|---|
| | | | Cancer | ID | AI | Cancer | ID | AI |
| MIP-3 alpha | Chemotactic for T cells, DCs | | X | X | ? | ? | ? | X |
| fractalkine | Chemotactic for T cells and monocytes | Endothelial cells | X | X | ? | ? | ? | X |
| IL-4 | Stimulates B cells, Th2 proliferation, plasma cell differentiation, IgE, upregulates MHC Class II expression, decreases IFN-gamma production | Th2 cells, basophils | ? | X | ? | X | X | X |
| IL-10 | Downregulates Th1 cytokines/MHC Class II expression/Co-stimulatory molecule expression | Monocytes Th2 cells, regulatory T cells | X | ? | X | X | X | X |
| IL-5 | Stimulates B cells, Ig secretion, eosinophil activation | Th2 cells, mast cells | ? | X | ? | X | X | X |
| IL-13 | Similar to IL4, induces IgE production, Th2 cytokine | Th2 cells, NK cells, mast cells, eosinophils, basophils | ? | X | ? | X | X | X |
| TGF-beta | Inhibits T cell proliferation, activity, function; blocks effects of pro-inflammatory cytokines | regulatory T cells | ? | ? | X | X | X | ? |
| IL-1 beta | Induces fevers, pro-inflammatory | Macrophages | X | X | ? | X | ? | X |
| IL-6 | Pro-inflammatory, drives osteoclast formation, drives Th17 | T cells, macrophages | ? | X | ? | X | X | X |
| IL-8 | Recruits neutrophils to site of infection | Macrophages, epithelial cells | ? | X | ? | X | ? | X |
| IL-31 | Cell-mediated immunity, pro-inflammatory | Th2 cells, macrophages, DCs | X | X | ? | X | ? | X |
| IL-15 | T cell proliferation and survival | T cells, NK cells | X | X | X | ? | ? | ? |
| IL-9 | Th2 proliferation, cytokine secretion | T cells, neutrophils, mast cells | ? | ? | X | X | X | ? |

ID = Infectious disease
IA = Autoimmune disease

In some embodiments, a tumor antigen stimulates one or more lymphocyte responses that are beneficial to the subject. In some embodiments, a tumor antigen inhibits and/or suppresses one or more lymphocyte responses that are deleterious or non-beneficial to the subject. Examples of immune responses that may lead to beneficial anti-tumor responses include but are not limited to 1) cytotoxic CD8+ T cells which can effectively kill cancer cells and release the mediators perforin and/or granzymes to drive tumor cell death; and 2) CD4+ Th1 T cells which play an important role in host defense and can secrete IL-2, IFN-gamma and TNF-alpha. These are induced by IL-12, IL-2, and IFN gamma among other cytokines.

In some embodiments, a tumor antigen stimulates one or more lymphocyte responses that are deleterious or non-beneficial to the subject. In some embodiments, a tumor antigen inhibits and/or suppresses one or more lymphocyte responses that are beneficial to the subject. Examples of immune responses that may lead to deleterious or non-beneficial anti-tumor responses include but are not limited to 1) T regulatory cells which are a population of T cells that can suppress an immune response and secrete immunosuppressive cytokines such as TGF-beta and IL-10 and express the molecules CD25 and FoxP3; and 2) Th2 cells which target responses against allergens but are not productive against cancer. These are induced by increased IL-4 and IL-10 and can secrete IL-4, IL-5, IL-6, IL-9 and IL-13.

The disclosure provides methods and systems for identifying and selecting tumor antigens. In some embodiments, methods and systems described herein can identify and select one or more tumor antigens to which one or more immune responses are stimulated in a cancer subject who has not received a cancer therapy (or who has not responded and/or is not responding, clinically to a cancer therapy). In some embodiments, methods and systems described herein can identify and select one or more tumor antigens to which one or more immune responses are not stimulated in a cancer subject who has not received a cancer therapy (or who has not responded and/or is not responding, clinically to a cancer therapy). In some embodiments, methods and systems described herein can identify and select one or more tumor antigens to which one or more immune responses are inhibited and/or suppressed in a cancer subject who has not received a cancer therapy (or who has not responded and/or is not responding, clinically to a cancer therapy). In some embodiments, methods and systems described herein can identify and select one or more tumor antigens which elicit no or minimal immune responses in a cancer subject who has not received a cancer therapy (or who has not responded and/or is not responding, clinically to a cancer therapy).

In some embodiments, a composition comprising the one or more selected tumor antigens is administered to a cancer subject before, during, and/or after administration of a cancer therapy.

The disclosure provides methods for selecting tumor antigens identified by the methods herein based on comparison of a subject response profile to a target response profile. The disclosure also provides methods for selecting (or de-selecting) tumor antigens identified by the methods herein, based on association with desirable or beneficial responses. The disclosure also provides methods for selecting (or de-selecting) tumor antigens identified by the methods herein, based on association with undesirable, deleterious or non-beneficial responses. In some embodiments, the methods for selecting tumor antigens are combined. The methods may be combined in any order, e.g. selection may be carried out by comparison of a subject response profile to a target response profile, followed by selection based on association with a desirable (or undesirable) response; or, selection may be carried out based on association with a desirable (or undesirable) response, followed by comparison of the subject response profile to a target response profile.

Methods for identifying tumor antigens and potential tumor antigens are provided herein. Methods for generating or obtaining a subject response profile are provided herein. Methods for generating or obtaining a target response profile, e.g. a population-based or composite target response profile, are provided herein. Methods for comparison of a subject response profile to a target response profile are provided herein. Methods for determining whether a subject response profile is similar to a target response profile are provided herein.

In some embodiments, a subject response profile and target response profile are generated or obtained using the same plurality of polypeptides of interest. In some embodiments, a subject response profile and target response profile are generated or obtained using the same plurality of tumor antigens.

The target response profile includes a quantification, identification, and/or representation of one or more tumor antigens that stimulate lymphocytes, that do not stimulate lymphocytes, that inhibit and/or suppress lymphocytes, that deactivate lymphocytes, and/or to which lymphocytes are non-responsive.

In some embodiments, one or more tumor antigens are identified as inhibiting and/or suppressing lymphocytes in the test subject (e.g., identified from the subject response profile), and the same one or more tumor antigens are identified as stimulating lymphocytes in the target subject (e.g., identified from the target response profile). In some embodiments, one or more tumor antigens are identified as stimulating lymphocytes in the test subject (e.g., identified from the subject response profile) and the same one or more tumor antigens are identified as inhibiting and/or suppressing lymphocytes in the target subject (e.g., identified from the target response profile). In some embodiments, one or more tumor antigens or potential tumor antigens are identified as eliciting minimal or no response from lymphocytes in the test subject (e.g., identified from the subject response profile), and the same one or more tumor antigens are identified as stimulating, or inhibiting and/or suppressing lymphocytes in the target subject (e.g., identified from the target response profile). In some embodiments, one or more tumor antigens are identified as stimulating, or inhibiting and/or suppressing, lymphocytes in the test subject (e.g., identified from the subject response profile), and the same one or more tumor antigens are identified as eliciting minimal or no response from lymphocytes in the target subject (e.g., identified from the target response profile).

Tumor antigens may be identified and/or selected on the basis of similarity or dissimilarity of a subject response profile to a target response profile. Tumor antigens may be identified and/or selected (or de-selected) based on association with desirable or beneficial responses. Tumor antigens may be identified and/or selected (or de-selected) based on association with undesirable, deleterious or non-beneficial responses. Tumor antigens may be identified and/or selected (or de-selected) based on a combination of the preceding methods, applied in any order.

All Positive Responders

In some embodiments, a subject response profile is compared to a corresponding response profile from a cancer subject who responds and/or has responded clinically to a cancer therapy (a "target response profile" of a responsive subject described herein). In some embodiments, a subject response profile is compared to a target response profile from a target subject who has not been diagnosed with cancer. In some embodiments, a subject response profile is compared to a target response profile from a target subject who has (or had) a beneficial response to cancer. In some embodiments, the subject has (or had) a positive clinical response to a cancer therapy or combination of therapies. In some embodiments, the subject had a spontaneous response to a cancer. In some embodiments, the subject is in partial or complete remission from cancer. In some embodiments, the subject has cleared a cancer. In some embodiments, the subject has not had a relapse, recurrence or metastasis of a cancer. In some embodiments, the subject has a positive cancer prognosis. In some embodiments, the subject has not experienced toxic responses or side effects to a cancer therapy or combination of therapies.

In some embodiments, one or more tumor antigens of the subject response profile which elicit responses that are different from, or dissimilar to, responses elicited by the same tumor antigens of the target response profile are selected. In some embodiments, one or more tumor antigens are selected (or de-selected) based on association with desirable or beneficial immune responses. In some embodiments, one or more tumor antigens are selected (or de-selected) based on association with undesirable, deleterious, or non-beneficial immune responses.

Responses whereby tumor antigens or immunogenic fragments thereof (i) stimulate lymphocyte responses that are beneficial to the subject, (ii) stimulate expression of cytokines that are beneficial to the subject, (iii) inhibit and/or suppress lymphocyte responses that are deleterious or non-beneficial to the subject, or (iv) inhibit and/or suppress expression of cytokines that are deleterious or non-beneficial to the subject, are termed "beneficial responses".

In some embodiments, a selected tumor antigen stimulates one or more lymphocyte responses that are beneficial to the subject. In some embodiments, a selected tumor antigen inhibits and/or suppresses one or more lymphocyte responses that are deleterious or non-beneficial to the subject.

In some embodiments, a selected tumor antigen increases expression and/or secretion of cytokines that are beneficial to the subject. In some embodiments, a selected tumor antigen inhibits and/or suppresses expression of cytokines that are deleterious or non-beneficial to the subject.

In some embodiments, administration of one or more selected tumor antigens to the subject elicits an immune response of the subject. In some embodiments, administration of one or more selected tumor antigens to the subject elicits a beneficial immune response of the subject. In some embodiments, administration of one or more selected tumor antigens to the subject elicits a beneficial response of the subject. In some embodiments, administration of one or more selected tumor antigens to the subject improves clinical response of the subject to a cancer therapy.

All Negative Responders

In some embodiments, a subject response profile is compared to a corresponding response profile from a cancer subject who does not respond and/or has not responded clinically to a cancer therapy (a "target response profile" of a non-responsive subject described herein). In some embodiments, a subject response profile is compared to a target response profile from a target subject who has (or had) a deleterious or non-beneficial response to cancer. In some embodiments, the subject has (or had) a negative clinical response to a cancer therapy or combination of therapies. In some embodiments, the subject has not cleared a cancer. In some embodiments, the subject has had a relapse, recurrence or metastasis of a cancer. In some embodiments, the subject has a negative cancer prognosis. In some embodiments, the subject has experienced toxic responses or side effects to a cancer therapy or combination of therapies.

Responses whereby tumor antigens or immunogenic fragments thereof (i) stimulate lymphocyte responses that are deleterious or not beneficial to the subject, (ii) stimulate expression of cytokines that are deleterious or not beneficial to the subject, (iii) inhibit and/or suppress lymphocyte responses that are beneficial to the subject, or (iv) inhibit and/or suppress expression of cytokines that are beneficial to the subject, are termed "deleterious or non-beneficial responses".

In some embodiments, one or more tumor antigens of the subject response profile which elicit responses that are the same as, or similar to, responses elicited by the same tumor antigens of the target response profile are selected. In some embodiments, one or more tumor antigens are selected (or de-selected) based on association with desirable or beneficial immune responses. In some embodiments, one or more tumor antigens are selected (or de-selected) based on association with undesirable, deleterious, or non-beneficial immune responses.

In some embodiments, a selected tumor antigen stimulates one or more lymphocyte responses that are deleterious or non-beneficial to the subject. In some embodiments, a selected tumor antigen inhibits and/or suppresses one or more lymphocyte responses that are beneficial to the subject.

In some embodiments, a selected tumor antigen increases expression and/or secretion of cytokines that are deleterious or non-beneficial to the subject. In some embodiments, a selected tumor antigen inhibits and/or suppresses expression of cytokines that are beneficial to the subject.

In some embodiments, the one or more tumor antigens are de-selected by the methods herein.

In some embodiments, the one or more selected tumor antigens are excluded from administration to a subject.

Methods of Selecting Potential Tumor Antigens

In well-established tumors, activation of endogenous anti-tumor T cell responses is often insufficient to result in complete tumor regression. Moreover, T cells that have been educated in the context of the tumor microenvironment sometimes are sub-optimally activated, have low avidity, and ultimately fail to recognize the tumor cells that express antigen. In addition, tumors are complex and comprise numerous cell types with varying degrees of expression of mutated genes, making it difficult to generate polyclonal T cell responses that are adequate to control tumor growth. As a result, researchers in the field have proposed that it is important in cancer subjects to identify the mutations that are "potential tumor antigens" in addition to those that are confirmed in the cancer subject to be recognized by their T cells.

There are currently no reliable methods of identifying potential tumor antigens in a comprehensive way. Computational methods have been developed in an attempt to predict what is an antigen, however there are many limitations to these approaches. First, modeling epitope prediction and presentation needs to take into account the greater than 12,000 HLA alleles encoding MHC molecules, with each subject expressing as many as 14 of them, all with different epitope affinities. Second, the vast majority of predicted epitopes fail to be found presented by tumors when they are evaluated using mass spectrometry. Third, the predictive algorithms do not take into account T cell recognition of the antigen, and the majority of predicted epitopes are incapable of eliciting T cell responses even when they are present. Finally, the second arm of cellular immunity, the CD4+ T cell subset, is often overlooked; the majority of in silico tools focus on MHC class I binders. The tools for predicting MHC class II epitopes are under-developed and more variable.

The present disclosure provides methods to a) identify polypeptides that are potential tumor antigens in antigen presentation assays of the disclosure, and b) select polypeptides on the basis of their antigenic potential. The methods are performed without making predictions about what could be a target of T cell responses or presented by MHC, and without the need for deconvolution. The methods can be expanded to explore antigenic potential in healthy subjects who share the same MHC alleles as a subject, to identify those potential tumor antigens that would be most suitable to include in an immunogenic composition or vaccine formulation. The methods ensure that the potential tumor antigen is processed and presented in the context of subject MHC molecules, and that T cells can respond to the potential tumor antigen if they are exposed to the potential tumor antigen under the right conditions (e.g., in the context of a vaccine with a strong danger signal from an adjuvant or delivery system).

The preceding methods for selection of tumor antigens may be applied to selection of potential tumor antigens, that is, polypeptides encoding one or more mutations present or expressed in a cancer or tumor cell of a subject.

Immunogenic Compositions and Uses Thereof

The present disclosure provides compositions that include a tumor antigen or tumor antigens identified or selected by methods described herein, nucleic acids encoding the tumor antigens, and methods of using the compositions. In some embodiments, a composition includes tumor antigens that are peptides 8-40 amino acids, 8-60 amino acids, 8-100. 8-150, or 8-200 amino acids in length (e.g., MHC binding peptides, e.g., peptides 23-29, 24-28, 25-27, 8-30, 8-29, 8-28, 8-27, 8-26, 8-25, 8-24, 8-23, 8-22, 8-21, 8-20, 8-15, 8-12 amino acids in length). In some embodiments, a composition includes one or more tumor antigens that are about 70%, 75%, 80%, 85%, 90%, 95%, 96%, 97%, 98%, 99% or 100% of the length of the full-length polypeptides. In some embodiments, a composition includes one or more tumor antigens that are truncated by about 1, 2, 3, 4, 5, 10, 15, 20, 25, 30, 35, 40, 45, 50, or more amino acids, relative to the full-length polypeptides. The compositions can include tumor antigens that are, or that comprise, MHC class I-binding peptides, MHC class II-binding peptides, or both MHC class I and MHC class II-binding peptides. Compositions can include a single tumor antigen, or multiple tumor antigens. In some embodiments, a composition includes a set of two, three, four, five, six, seven, eight, nine, ten, or more tumor antigens. In some embodiments, a composition includes ten, fifteen, twenty, twenty-five, thirty, or more tumor antigens. In some embodiments, the tumor antigens or peptides are provided as one or more fusion proteins. In a some embodiments, a composition comprises nucleic acids encoding the tumor antigens or peptides. In some embodiments, the nucleic acids encoding the tumor antigens or peptides are provided as one or more fusion constructs.

The present disclosure provides immunogenic compositions comprising any combination of two or three TAAs: HPSE1 (SEQ ID NO: 6), HPSE2 (SEQ ID NO: 7), and/or SMAD4 (SEQ ID NO: 8).

HPSE encodes Heparinase, an endoglycosidase that cleaves heparan sulfate proteoglycans (HSPGs) into heparan sulfate side chains and core proteoglycans HPSE participates in extracellular matrix (ECM) degradation and remodeling. There is a single functional heparinase: HPSE isoform 1 (HPSE1), a 543 amino acid protein. The splice variant HPSE isoform 2 (HPSE2) has no enzymatic activity, but may regulate HPSE1 activity. The active protein form of HPSE1 is a heterodimer of 8 and 50 kDa subunits which are non-covalently linked. The TIM barrel fold domain contains the active site, and the C-terminal domain of the protein is involved in nonenzymatic signaling and secretory functions. Potential T-cell epitopes within HPSE have been described (Tang. In vitro and ex vivo evaluation of a multi-epitope heparinase vaccine for various malignancies. Cancer Sci 105 (2014) 9-17). The protein sequences of HPSE1 and HPSE2 may be found by searching in the publicly available database, UniProt (on the World Wide Web, at http://www.uniprot.org/uniprot/Q9Y251) and http://www.uniprot.org/uniprot/Q8WWQ2 respectively). The DNA sequence of HPSE1 and HPSE2 may be found by searching in the publicly available database, Entrez (on the World Wide Web https://www.ncbi.nlm.nih.gov/gene/10855 and https://www.ncbi.nlm.nih.gov/gene/60495 respectively).

SMAD4 encodes Mothers against decapentaplegic homolog 4, a signal transduction protein and tumor suppressor gene, which is a central mediator of downstream transcriptional output in TGFb signaling pathways. SMAD4 is a 552 amino acid, 60.4 KDa protein. SMAD4 exists as a monomer in the absence of TGF-beta activation, and a heterodimer on TGF-beta activation, SMAD4 is composed of two molecules of a C-terminally phosphorylated R-SMAD molecule, SMAD2 or SMAD3, and one molecule of SMAD4 to form the transcriptional active SMAD2/SMAD3-SMAD4 complex. SMAD4 regulates transcription of a number of target genes through binding to DNA, recognizing an 8-bp palindromic sequence (GTCTAGAC) called the Smad-binding element (SBE). The protein acts as a tumor suppressor and inhibits epithelial cell proliferation. The protein and DNA sequences of SMAD4 may be found by searching in the publicly available databases, UniProt and Entrez (on the World Wide Web, at http://www.uniprot.org/uniprot/Q13485 and https://www.ncbi.nlm.nih.gov/gene/4089 respectively).

The disclosure also provides nucleic acids encoding the tumor antigens. The nucleic acids can be used to produce expression vectors, e.g., for recombinant production of the tumor antigens, or for nucleic acid-based administration in vivo (e.g., DNA vaccination).

In some embodiments, tumor antigens are used in diagnostic assays. For these assays, compositions including the tumor antigens can be provided in kits, e.g., for detecting antibody reactivity, or cellular reactivity, in a sample from an individual.

In some embodiments, tumor antigen compositions are used to induce an immune response in a subject. In some embodiments, the subject is a human. In some embodiments, the subject is a non-human animal. The tumor antigen compositions can be used to raise antibodies (e.g., in a non-human animal, such as a mouse, rat, hamster, or goat), e.g., for use in diagnostic assays, and for therapeutic applications. For an example of a therapeutic use, a tumor antigen discovered by a method described herein may be a potent T cell and/or B cell antigen. Preparations of antibodies may be produced by immunizing a subject with the tumor antigen and isolating antiserum from the subject. Methods for eliciting high titers of high affinity, antigen-specific antibodies, and for isolating the tumor antigen-specific antibodies from antisera, are known in the art. In some embodiments, the tumor antigen compositions are used to raise monoclonal antibodies, e.g., human monoclonal antibodies.

In some embodiments, a tumor antigen composition is used to induce an immune response in a human subject to provide a therapeutic response. In some embodiments, a tumor antigen composition is used to induce an immune response in a human subject that redirects an undesirable immune response. In some embodiments, a tumor antigen composition elicits an immune response that causes the subject to have a positive clinical response described herein, e.g., as compared to a subject who has not been administered the tumor antigen composition. In some embodiments, a tumor antigen composition elicits an immune response that causes the subject to have an improved clinical response, e.g., as compared to a subject who has not been administered the tumor antigen composition. In some embodiments, a tumor antigen composition is used to induce an immune response in a human subject for palliative effect. The response can be complete or partial therapy.

In some embodiments, a tumor antigen composition is used to induce an immune response in a human subject to provide a prophylactic response. The response can be complete or partial protection.

In some embodiments, immunogenicity of a tumor antigen is evaluated in vivo. In some embodiments, humoral responses to a tumor antigen are evaluated (e.g., by detecting antibody titers to the administered tumor antigen). In some embodiments, cellular immune responses to a tumor antigen are evaluated, e.g., by detecting the frequency of antigen-specific cells in a sample from the subject (e.g., by staining T cells from the subject with MHC/peptide tetramers containing the antigenic peptide, to detect antigen-specific T cells, or by detecting antigen-specific cells using an antigen presentation assay such as an assay described herein). In some embodiments, the ability of a tumor antigen or antigens to elicit protective or therapeutic immunity is evaluated in an animal model. In some embodiments, the ability of a tumor antigen or antigens to stimulate or to suppress and/or inhibit immunity is evaluated in an animal model.

In some embodiments, the composition includes a pharmaceutically acceptable carrier or excipient. An immunogenic composition may also include an adjuvant for enhancing the immunogenicity of the formulation, (e.g., oil in water, incomplete Freund's adjuvant, aluminum phosphate, aluminum hydroxide, saponin adjuvants, toll-like receptor agonists, or muramyl dipeptides). Other adjuvants are known in the art.

In some embodiments, an immunogenic composition includes a tumor antigen linked to a carrier protein. Examples of carrier proteins include, e.g., toxins and toxoids (chemical or genetic), which may or may not be mutant, such as anthrax toxin, PA and DNI (PharmAthene, Inc.), diphtheria toxoid (Massachusetts State Biological Labs; Serum Institute of India, Ltd.) or CRM 197, tetanus toxin, tetanus toxoid (Massachusetts State Biological Labs; Serum Institute of India, Ltd.), tetanus toxin fragment Z, exotoxin A or mutants of exotoxin A of *Pseudomonas aeruginosa*, bacterial flagellin, pneumolysin, an outer membrane protein of *Neisseria meningitidis* (strain available from the ATCC (American Type Culture Collection, Manassas, Va.)), *Pseudomonas aeruginosa* Hcp1 protein, *E. coli* heat labile enterotoxin, shiga-like toxin, human LTB protein, a protein extract from whole bacterial cells, and any other protein that can be cross-linked by a linker. Other useful carrier proteins include high density lipoprotein (HDL), bovine serum albumin (BSA), P40, and chicken riboflavin. Many carrier proteins are commercially available (e.g., from Sigma Aldrich).

In some embodiments, an immunogenic composition including a tumor antigen identified by a method described herein is used in conjunction with an available vaccine. For example, an antigen identified as described herein can be used as a supplemental component of a vaccine formulation, or as a boosting antigen in a vaccination protocol.

In some embodiments, an immunogenic composition is in a volume of about 0.5 mL for subcutaneous injection, 0.1 mL for intradermal injection, or 0.002-0.02 mL for percutaneous administration. A 0.5 ml dose of the composition may contain approximately 2-500 ug of the tumor antigen.

In some embodiments an immunogenic composition is administered parenterally (for instance, by subcutaneous, intramuscular, intravenous, or intradermal injection). In some embodiments, delivery by a means that physically penetrates the dermal layer is used (e.g., a needle, airgun, or abrasion).

In some embodiments, an immunogenic composition is administered to a subject, e.g., by intramuscular injection, intradermal injection, or transcutaneous immunization with appropriate immune adjuvants. Compositions can be administered, one or more times, often including a second administration designed to boost an immune response in a subject. The frequency and quantity of dosage of the composition can vary depending on the specific activity of the composition and clinical response of the subject, and can be determined by routine experimentation.

The formulations of immunogenic compositions can be provided in unit-dose or multi-dose containers, for example, sealed ampoules and vials and may be stored in a freeze-dried (lyophilized) condition requiring only the addition of the sterile liquid carrier immediately prior to use.

Production of Tumor Antigens

A tumor antigen suitable for use in any method or composition of the disclosure may be produced by any available means, such as recombinantly or synthetically (see, e.g., Jaradat Amino Acids 50:39-68 (2018); Behrendt et al., J. Pept. Sci. 22:4-27 (2016)). For example, a tumor antigen may be recombinantly produced by utilizing a host cell system engineered to express a tumor antigen-encoding nucleic acid. Alternatively or additionally, a tumor antigen may be produced by activating endogenous genes. Alternatively or additionally, a tumor antigen may be partially or fully prepared by chemical synthesis.

Where proteins are recombinantly produced, any expression system can be used. To give but a few examples, known expression systems include, for example, *E. coli*, egg, baculovirus, plant, yeast, or mammalian cells.

In some embodiments, recombinant tumor antigen suitable for the present invention are produced in mammalian cells. Non-limiting examples of mammalian cells that may be used in accordance with the present invention include BALB/c mouse myeloma line (NSO/1, ECACC No: 85110503); human retinoblasts (PER.C6, CruCell, Leiden, The Netherlands); monkey kidney CV1 line transformed by SV40 (COS-7, ATCC CRL 1651); human embryonic kidney line (HEK293 or 293 cells subcloned for growth in suspension culture, Graham et al., J. Gen Virol., 36:59, 1977); human fibrosarcoma cell line (e.g., HT1080); baby hamster kidney cells (BHK21, ATCC CCL 10); Chinese hamster ovary cells +/−DHFR (CHO, Urlaub and Chasin, Proc. Natl. Acad. Sci. USA, 77:4216, 1980); mouse sertoli cells (TM4, Mather, Biol. Reprod., 23:243-251, 1980); monkey kidney cells (CV1 ATCC CCL 70); African green monkey kidney cells (VERO-76, ATCC CRL-1 587); human cervical carcinoma cells (HeLa, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., Annals N.Y. Acad. Sci., 383:44-68, 1982); MRC 5 cells; FS4 cells; and a human hepatoma line (Hep G2).

In some embodiments, the present invention provides recombinant tumor antigen produced from human cells. In some embodiments, the present invention provides recombinant tumor antigen produced from CHO cells or HT1080 cells.

Typically, cells that are engineered to express a recombinant tumor antigen may comprise a transgene that encodes a recombinant tumor antigen described herein. It should be appreciated that the nucleic acids encoding recombinant tumor antigen may contain regulatory sequences, gene control sequences, promoters, non-coding sequences and/or other appropriate sequences for expressing the recombinant tumor antigen. Typically, the coding region is operably linked with one or more of these nucleic acid components.

The coding region of a transgene may include one or more silent mutations to optimize codon usage for a particular cell type. For example, the codons of a tumor antigen transgene may be optimized for expression in a vertebrate cell. In some embodiments, the codons of a tumor antigen transgene may be optimized for expression in a mammalian cell. In some embodiments, the codons of a tumor antigen transgene may be optimized for expression in a human cell.

Methods of Manufacturing Immunogenic Compositions

In some embodiments, the disclosure provides methods of manufacturing an immunogenic composition for administration to a subject in need thereof, the method comprising: a) providing, preparing, or obtaining a plurality of antigenic compositions comprising a plurality of antigens, each composition comprising a different antigen; b) providing, preparing, or obtaining a target response profile, wherein the target response profile comprises a representation of the level of expression and/or secretion of one or more immune mediators associated (e.g., determined, measured, observed) with the plurality of antigens; c) providing, preparing, or obtaining a subject response profile, wherein the subject response profile comprises a representation of the level of expression and/or secretion of one or more immune mediators associated (e.g., determined, measured, observed) with the plurality of antigens; d) comparing the target response profile to the subject response profile; e) selecting one or more antigens based on the comparison; and f) formulating at least a portion of one or more antigenic compositions comprising the one or more selected antigens as a pharmaceutical composition.

In some instances, about 1, 2, 5, 10, 20, 40, 60, 80, 100, 150, 200 or more, antigenic compositions are provided, prepared, or obtained. For example, a plurality of antigens can be produced using a method described herein, e.g., recombinantly or synthetically. The antigens can be provided in a suitable composition, such as a solution or lyophilized composition. In some instances, the antigens are synthetically produced. In some instances, a synthetically produced antigen remains attached to a solid support. In some instances, formulating an antigen includes aliquoting a portion of the antigenic composition, reconstituting at least a portion of a lyophilized antigenic composition, and/or releasing a synthetically produced antigen from a solid support.

Antigenic compositions may be prepared or obtained and stored in a variety of forms, such as in a suspension, in solution, or lyophilized. Antigenic compositions may be stored at a temperature ranging from less than −80° C. to about room temperature, for example at about −80° C., about −20° C., about −15° C., about −10° C., about 4° C. or at about room temperature. In some embodiments, antigenic compositions may include a carrier, excipient, stabilizer, preservative and/or adjuvant.

A plurality of antigens can be derived from a target response profile wherein the target response profile comprises a representation of the level of expression and/or secretion of one or more immune mediators associated with (e.g., determined, measured, observed) with the plurality of antigens.

A plurality of antigens can be derived from a subject response profile wherein the subject response profile comprises a representation of the level of expression and/or secretion of one or more immune mediators associated with (e.g., determined, measured, observed) with the plurality of antigens.

In some embodiments, a target response profile and subject response profile are compared and one or more antigens are selected based on the comparison. In some embodiments, one or more antigens are selected that increase expression or secretion of immune mediators associated with a beneficial response to cancer, and/or one or more antigens that inhibit and/or suppress expression or secretion of immune mediators associated with deleterious or not beneficial responses to cancer. The selected antigens, or a portion of the selected antigens may be formulated as a pharmaceutical composition.

Cancer and Cancer Therapy

The present disclosure provides methods and systems related to subjects having or diagnosed with cancer, such as a tumor. In some embodiments, a tumor is or comprises a hematologic malignancy, including but not limited to, acute lymphoblastic leukemia, acute myeloid leukemia, chronic lymphocytic leukemia, chronic myelogenous leukemia, hairy cell leukemia, AIDS-related lymphoma, Hodgkin lymphoma, non-Hodgkin lymphoma, Langerhans cell histiocytosis, multiple myeloma, or myeloproliferative neoplasms.

In some embodiments, a tumor is or comprises a solid tumor, including but not limited to breast carcinoma, a squamous cell carcinoma, a colon cancer, a head and neck cancer, ovarian cancer, a lung cancer, mesothelioma, a genitourinary cancer, a rectal cancer, a gastric cancer, or an esophageal cancer.

In some particular embodiments, a tumor is or comprises an advanced tumor, and/or a refractory tumor. In some embodiments, a tumor is characterized as advanced when certain pathologies are observed in a tumor (e.g., in a tissue sample, such as a biopsy sample, obtained from a tumor) and/or when cancer patients with such tumors are typically considered not to be candidates for conventional chemotherapy. In some embodiments, pathologies characterizing tumors as advanced can include tumor size, altered expression of genetic markers, invasion of adjacent organs and/or lymph nodes by tumor cells. In some embodiments, a tumor is characterized as refractory when patients having such a tumor are resistant to one or more known therapeutic modalities (e.g., one or more conventional chemotherapy regimens) and/or when a particular patient has demonstrated resistance (e.g., lack of responsiveness) to one or more such known therapeutic modalities.

In some embodiments, the present disclosure provides methods and systems related to cancer therapy. The present disclosure is not limited to any specific cancer therapy, and any known or developed cancer therapy is encompassed by the present disclosure. Known cancer therapies include, e.g., administration of chemotherapeutic agents, radiation therapy, surgical excision, chemotherapy following surgical excision of tumor, adjuvant therapy, localized hypothermia or hyperthermia, anti-tumor antibodies, and anti-angiogenic agents. In some embodiments, cancer and/or adjuvant therapy includes a TLR agonist (e.g., CpG, Poly I:C, etc., see, e.g., Wittig et al., Crit. Rev. Oncol. Hematol. 94:31-44 (2015); Huen et al., Curr. Opin. Oncol. 26:237-44 (2014); Kaczanowska et al., J. Leukoc. Biol. 93:847-863 (2013)), a STING agonist (see, e.g., US20160362441; US20140329889; Fu et al., Sci. Transl. Med. 7:283ra52 (2015); and WO2014189805), a non-specific stimulus of innate immunity, and/or dendritic cells, or administration of GM-CSF, Interleukin-12, Interleukin-7, Flt-3, or other cytokines. In some embodiments, the cancer therapy is or comprises oncolytic virus therapy, e.g., talimogene leherparepvec. (see, e.g., Fukuhara et al., Cancer Sci. 107: 1373-1379 (2016)). In some embodiments, the cancer therapy is or comprises bi-specific antibody therapy (e.g., Choi et al., 2011 *Expert Opin Biol Ther*; Huehls et al., 2015, *Immunol and Cell Biol*). In some embodiments, the cancer therapy is or comprises cellular therapy such as chimeric antigen receptor T (CAR-T) cells, TCR-transduced T cells, dendritic cells, tumor infiltrating lymphocytes (TIL), or natural killer (NK) cells (e.g., as reviewed in Sharpe and Mount, 2015, *Dis Model Mech* 8:337-50).

Anti-tumor antibody therapies (i.e., therapeutic regimens that involve administration of one or more anti-tumor antibody agents) are rapidly becoming the standard of care for treatment of many tumors. Antibody agents have been designed or selected to bind to tumor antigens, particularly those expressed on tumor cell surfaces. Various review articles have been published that describe useful anti-tumor antibody agents (see, for example, Adler et al., Hematol. Oncol. Clin. North Am. 26:447-81 (2012); Li et al., Drug Discov. Ther. 7:178-84 (2013); Scott et al., Cancer Immun. 12:14 (2012); and Sliwkowski et al., Science 341:1192-1198 (2013)). The below Table 8 presents a non-comprehensive list of certain human antigens targeted by known, available antibody agents, and notes c Certain cancer indications for which the antibody agents have been proposed to be useful:

TABLE 8

| Human Antigen | Antibody (commercial or scientific name) | Cancer indication |
| --- | --- | --- |
| CD2 | Siplizumab | Non-Hodgkin's Lymphoma |
| CD3 | UCHT1 | Peripheral or Cutaneous T-cell Lymphoma |
| CD4 | HuMax-CD4 | |
| CD19 | SAR3419, MEDI-551 | Diffuse Large B-cell Lymphoma |
| CD19 and CD3 or CD22 | Bispecific antibodies such as Blinatumomab, DT2219ARL | Non-Hodgkin's Lymphoma |
| CD20 | Rituximab, Veltuzumab, Tositumomab, Ofatumumab, Ibritumomab, Obinutuzumab, | B cell malignancies (Non-Hodgkin's lymphoma, Chronic lymphocytic leukemia) |
| CD22 (SIGLEC2) | Inotuzumab, tetraxetan, CAT-8015, DCDT2980S, Bectumomab | Chemotherapy-resistant hairy cell leukemia, Hodgkin's lymphoma |
| CD30 | Brentuximab vedotin | |
| CD33 | Gemtuzumab ozogamicin (Mylotarg) | Acute myeloid leukemia |
| CD37 | 16 | Chronic lymphocytic leukemia |
| CD38 | mumab | Multiple myeloma, hematological tumors |
| CD40 | mumab | Non-Hodgkin's lymphoma |
| CD52 | Alemtuzumab (Campath) | Chronic lymphocytic leukemia |
| CD56 (NCAM1) | Lorvotuzumab | Small Cell Lung Cancer |
| CD66e (CEA) | Labetuzumab | Breast, colon and lung tumors |
| CD70 | SGN-75 | Non-Hodgkin's lymphoma |
| CD74 | Milatuzumab | Non-Hodgkin's lymphoma |
| CD138 (SYND1) | BT062 | Multiple Myeloma |
| CD152 (CTLA-4) | Ipilimumab | Metastatic melanoma |
| CD221 (IGF1R) | AVE1642, IMC-A12, MK-0646, R150, CP 751871 | Glioma, lung, breast, head and neck, prostate and thyroid cancer |
| CD254 (RANKL) | Denosumab | Breast and prostate carcinoma |
| CD261 (TRAILR1) | Mapatumumab | Colon, lung and pancreas tumors and haematological malignancies |
| CD262 (TRAILR2) | HGS-ETR2, CS-1008 | |
| CD326 (Epcam) | Edrecolomab, 17-1A, IGN101, Catumaxomab, Adecatumumab | Colon and rectal cancer, malignant ascites, epithelial tumors (breast, colon, lung) |
| CD309 (VEGFR2) | IM-2C6, CDP791 | Epithelium-derived solid tumors |
| CD319 (SLAMF7) | HuLuc63 | Multiple myeloma |
| CD340 (HER2) | Trastuzumab, Pertuzumab, Ado-trastuzumab emtansine | Breast cancer |
| CAIX (CA9) | cG250 | Renal cell carcinoma |
| EGFR (c-erbB) | Cetuximab, Panitumumab, nimotuzumab and 806 | Solid tumors including glioma, lung, breast, colon, and head and neck tumors |
| EPHA3 (HEK) | KB004, IIIA4 | Lung, kidney and colon tumors, melanoma, glioma and haematological malignancies |
| Episialin | Epitumomab | Epithelial ovarian tumors |
| FAP | Sibrotuzumab and F19 | Colon, breast, lung, pancreas, and head and neck tumors |
| HLA-DR beta | Apolizumab | Chronic lymphocytic leukemia, non-Hodkin's lymphoma |
| FOLR-1 | Farletuzumab | Ovarian tumors |
| 5T4 | Anatumomab | Non-small cell lung cancer |
| GD3/GD2 | 3F8, ch14.18, KW-2871 | Neuroectodermal and epithelial tumors |
| gpA33 | huA33 | Colorectal carcinoma |
| GPNMB | Glembatumumab | Breast cancer |
| HER3 (ERBB3) | MM-121 | Breast, colon, lung, ovarian, and prostate tumors |
| Integrin αVβ3 | Etaracizumab | Tumor vasculature |
| Integrin α5β1 | Volociximab | Tumor vasculature |
| Lewis-Y antigen | hu3S193, IgN311 | Breast, colon, lung and prostate tumors |
| MET (HGFR) | AMG 102, METMAB, SCH900105 | Breast, ovary and lung tumors |
| Mucin-1/CanAg | Pemtumomab, oregovomab, Cantuzumab | Breast, colon, lung and ovarian tumors |
| PSMA | ADC, J591 | Prostate Cancer |
| Phosphatidylserine | Bavituximab | Solid tumors |
| TAG-72 | Minretumomab | Breast, colon and lung tumors |
| Tenascin | 8106 | Glioma, breast and prostate tumours |
| VEGF | Bevacizumab | Tumor vasculature |
| PD-L1 | Avelumab | Non-small cell lung cancer, MCC |
| CD274 | Durvalumab | Non-small cell lung cancer |
| IDO enzyme | IDO inhibitors | Multiple |

In some embodiments, a cancer therapy is or comprises immune checkpoint blockade therapy (see, e.g., Martin-Liberal et al., Cancer Treat. Rev. 54:74-86 (2017); Menon et al., Cancers (Basel) 8:106 (2016)), or immune suppression blockade therapy. Certain cancer cells thrive by taking advantage of immune checkpoint pathways as a major mechanism of immune resistance, particularly with respect to T cells that are specific for tumor antigens. For example, certain cancer cells may overexpress one or more immune checkpoint proteins responsible for inhibiting a cytotoxic T cell response. Thus, immune checkpoint blockade therapy may be administered to overcome the inhibitory signals and permit and/or augment an immune attack against cancer cells. Immune checkpoint blockade therapy may facilitate immune cell responses against cancer cells by decreasing, inhibiting, or abrogating signaling by negative immune response regulators (e.g., CTLA-4). In some embodiments, a cancer therapy or may stimulate or enhance signaling of positive regulators of immune response (e.g., CD28).

Examples of immune checkpoint blockade and immune suppression blockade therapy include agents targeting one or more of A2AR, B7-H4, BTLA, CTLA-4, CD28, CD40, CD137, GITR, IDO, KIR, LAG-3, PD-1, PD-L1, OX40, TIM-3, and VISTA. Specific examples of immune checkpoint blockade agents include the following monoclonal antibodies: ipilimumab (targets CTLA-4); tremelimumab (targets CTLA-4); atezolizumab (targets PD-L1); pembrolizumab (targets PD-1); nivolumab (targets PD-1); avelumab; durvalumab; and cemiplimab.

Specific examples of immune suppression blockade agents include: Vista (B7-H5, v-domain Ig suppressor of T cell activation) inhibitors; Lag-3 (lymphocyte-activation gene 3, CD223) inhibitors; IDO (indolemamine-pyrrole-2,3,-dioxygenase-1,2) inhibitors; KIR receptor family (killer cell immunoglobulin-like receptor) inhibitors; CD47 inhibitors; and Tigit (T cell immunoreceptor with Ig and ITIM domain) inhibitors.

In some embodiments, a cancer therapy is or comprises immune activation therapy. Specific examples of immune activators include: CD40 agonists; GITR (glucocorticoid-induced TNF-R-related protein, CD357) agonists; OX40 (CD134) agonists; 4-1BB (CD137) agonists; ICOS (inducible T cell stimulator); CD278 agonists; IL-2 (interleukin 2) agonists; and interferon agonists.

In some embodiments, cancer therapy is or comprises a combination of one or more immune checkpoint blockade agents, immune suppression blockade agents, and/or immune activators, or a combination of one or more immune checkpoint blockade agents, immune suppression blockade agents, and/or immune activators, and other cancer therapies.

As discussed herein, in some embodiments, the present disclosure provides methods and systems related to subjects who do not respond and/or have not responded; or respond and/or have responded (e.g., clinically responsive, e.g., clinically positively responsive or clinically negatively responsive) to a cancer therapy. In some embodiments, subjects respond and/or have responded positively clinically to a cancer therapy. In some embodiments, subjects respond and/or have responded negatively clinically to a cancer therapy. In some embodiments, subjects do not respond and/or have not responded (e.g., clinically non-responsive) to a cancer therapy.

Whether a subject responds positively, responds negatively, and/or fails to respond to a cancer therapy can be measured and/or characterized according to particular criteria. In certain embodiments, such criteria can include clinical criteria and/or objective criteria. In certain embodiments, techniques for assessing response can include, but are not limited to, clinical examination, positron emission tomography, chest X-ray, CT scan, MRI, ultrasound, endoscopy, laparoscopy, presence or level of a particular marker in a sample, cytology, and/or histology. A positive response, a negative response, and/or no response, of a tumor to a therapy can be assessed by ones skilled in the art using a variety of established techniques for assessing such response, including, for example, for determining one or more of tumor burden, tumor size, tumor stage, etc. Methods and guidelines for assessing response to treatment are discussed in Therasse et al., J. Natl. Cancer Inst., 2000, 92(3):205-216; and Seymour et al., Lancet Oncol., 2017, 18:e143-52.

In some embodiments, a responsive subject exhibits a decrease in tumor burden, tumor size, and/or tumor stage upon administration of a cancer therapy. In some embodiments, a non-responsive subject does not exhibit a decrease in tumor burden, tumor size, or tumor stage upon administration of a cancer therapy. In some embodiments, a non-responsive subject exhibits an increase in tumor burden, tumor size, or tumor stage upon administration of a cancer therapy.

In some embodiments, a cancer subject is identified and/or selected for administration of a cancer therapy as described herein. In some embodiments, the cancer therapy is administered to the subject. In some embodiments, upon administration of the cancer therapy, the subject exhibits a positive clinical response to the cancer therapy, e.g., exhibits an improvement based on one or more clinical and/or objective criteria (e.g., exhibits a decrease in tumor burden, tumor size, and/or tumor stage). In some embodiments, the clinical response is more positive than a clinical response to the cancer therapy administered to a cancer subject who is identified (using a method described herein) as a cancer subject who should not initiate, and/or should modify (e.g., reduce and/or combine with one or more other modalities), and/or should discontinue the cancer therapy, and/or should initiate an alternative cancer therapy.

Methods described herein can include preparing and/or providing a report, such as in electronic, web-based, or paper form. The report can include one or more outputs from a method described herein, e.g., a subject response profile described herein. In some embodiments, a report is generated, such as in paper or electronic form, which identifies the presence or absence of one or more tumor antigens (e.g., one or more stimulatory and/or inhibitory and/or suppressive tumor antigens, or tumor antigens to which lymphocytes are not responsive, described herein) for a cancer patient, and optionally, a recommended course of cancer therapy. In some embodiments, the report includes an identifier for the cancer patient. In one embodiment, the report is in web-based form.

In some embodiments, additionally or alternatively, a report includes information on prognosis, resistance, or potential or suggested therapeutic options. The report can include information on the likely effectiveness of a therapeutic option, the acceptability of a therapeutic option, or the advisability of applying the therapeutic option to a cancer patient, e.g., identified in the report. For example, the report can include information, or a recommendation, on the administration of a cancer therapy, e.g., the administration of a pre-selected dosage or in a pre-selected treatment regimen, e.g., in combination with one or more alternative cancer therapies, to the patient. The report can be delivered, e.g., to an entity described herein, within 7, 14, 21, 30, or 45 days from performing a method described herein. In some embodiments, the report is a personalized cancer treatment report.

In some embodiments, a report is generated to memorialize each time a cancer subject is tested using a method described herein. The cancer subject can be reevaluated at intervals, such as every month, every two months, every six months or every year, or more or less frequently, to monitor the subject for responsiveness to a cancer therapy and/or for an improvement in one or more cancer symptoms, e.g., described herein. In some embodiments, the report can record at least the treatment history of the cancer subject.

In one embodiment, the method further includes providing a report to another party. The other party can be, for example, the cancer subject, a caregiver, a physician, an oncologist, a hospital, clinic, third-party payor, insurance company or a government office.

All publications, patent applications, patents, and other references mentioned herein are incorporated by reference in their entirety. In addition, the materials, methods, and examples are illustrative only and not intended to be limiting. Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described herein.

The disclosure is further illustrated by the following examples. The examples are provided for illustrative purposes only. They are not to be construed as limiting the scope or content of the disclosure in any way.

EXAMPLES

Example 1. Immune Responses to the ATLAS Melanoma Tumor Associated Antigen (TAA) Library—Single Patient Responses Generation of the ATLAS Melanoma TAA Library 23 full-length genes (labelled as Un001-023, encoding known TAAs as shown below in Table 3) were obtained from the DNA Resource Core at Harvard Medical School, recloned into the ATLAS expression vector (Genocea Biosciences), and sequence-verified. Each TAA was recombinantly expressed in *E. coli*. Protein expression was verified using a surrogate T cell assay (the B3Z hybridoma) which recognizes the C57BL/6 mouse T cell epitope SIINFEKL (SEQ ID NO: 452), which is inserted at the C-terminus of each open reading frame, upstream of the stop codon. Proteins that induced B3Z responses that exceeded 5% of the positive control (the minimal SIINFEKL (SEQ ID NO: 452) epitope pulsed onto antigen presenting cells) were considered expressed.

TABLE 3

ATLAS melanoma TAA library

| Code | Antigen Name | Alias | Long Name | OMIM | GeneID |
| --- | --- | --- | --- | --- | --- |
| Un001 | MAGEA3 | HIP8; HYPD; CT1.3; MAGE3; MAGEA6, MAGE-A3 (G-2544) | MAGE family member A3 | 300174 | 4102 |
| Un002 | NY-ESO-1 | CTAG; ESO1; CT6.1; CTAG1; LAGE-2; LAGE2B; NY-ESO-1 | cancer/testis antigen 1B | 300156 | 1485 |
| Un003 | ANGPT1 | AGP1, AGPT, ANG1 | Angiopoietin-1 | 601667 | 284 |
| Un004 | XIAP | API3; ILP1; MIHA; XLP2; BIRC4; IAP-3; hIAP3; hIAP-3 | X-linked inhibitor of apoptosis | 300079 | 331 |
| Un005 | LGALS3 | L31; GAL3; MAC2; CBP35; GALBP; GALIG; LGALS2 | Galectin-3 | 153619 | 3958 |
| Un006 | VEGF-A | VPF; VEGF; MVCD1 | vascular endothelial growth factor A | 192240 | 7422 |
| Un007 | ATP6AP1 | 16A; CF2; Ac45; XAP3; XAP-3; ATP6S1; VATPS1; ATP6IP1 | ATPase H+ transporting accessory protein 1 | 300197 | 537 |
| Un008 | MAGEA1 | CT1.1; MAGE1 | MAGE family member A1 | 300016 | 4100 |
| Un009 | BIRC2 | API1; MIHB; HIAP2; RNF48; cIAP1; Hiap-2; c-IAP1 | baculoviral IAP repeat containing 2 | 601712 | 329 |
| Un010 | MIF | GIF; GLIF; MMIF, MIF | Macrophage migration inhibitory factor | 153620 | 4282 |
| Un011 | LGALS9 | HUAT; LGALS9A | Galectin-9 | 601879 | 3965 |

TABLE 3-continued

ATLAS melanoma TAA library

| Code | Antigen Name | Alias | Long Name | OMIM | GeneID |
|---|---|---|---|---|---|
| Un012 | PMEL | P1; SI; SIL; ME20; P100; SILV; ME20M; gp100; ME20-M; PMEL17; D12S53E | premelanosome protein | 155550 | 6490 |
| Un013 | GRN | GEP; GP88; PEPI; PGRN; CLN11; PCDGF | Progranulin | 138945 | 2896 |
| Un014 | OGFR | | opioid growth factor receptor | 606459 | 11054 |
| Un015 | BIRC5 | API4; EPR-1; survivin, BIRC5 | Surviving | 603352 | 332 |
| Un016 | BIRC7 | KIAP; LIVIN; MLIAP; RNF50; ML-IAP | baculoviral IAP repeat containing 7 | | 79444 |
| Un017 | TBX4 | SPS | T-box 4 | 601719 | 9496 |
| Un018 | SLPI | ALP; MPI; ALK1; BLPI; HUSI; WAP4; WFDC4; HUSI-I | Secretory leukocyte protein inhibitor | 107285 | 6590 |
| Un019 | ANGPT2 | AGPT2, ANG2 | Angiopoietin-2 | 601922 | 285 |
| Un020 | LGALS1 | GBP; GAL1 | Galectin-1 | 150570 | 3956 |
| Un021 Un100 | DCT | TRP-2; TYRP2,, TYRP-2 | dopachrome tautomerase | 191275 | 1638 |
| Un022 | MLANA | MART1; MART-1 | Melan-A | 605513 | 2315 |
| Un023 | TERT | TP2; TRT; CMM9; EST2; TCS1; hTRT; DKCA2; DKCB4; hEST2; PFBNIFT1 | telomerase reverse transcriptase | 187270 | 7015 |
| Un024 | LGMN | AEP; LGMN1; PRSC1 | legumain | 602620 | 5641 |
| Un025 | SPA17 | CT22; SP17; SP17-1 | sperm surface protein Sp17 | 608621 | 53340 |
| Un026 | HPV_E7 | | HPV E7 oncoprotein | | 1489079 |
| Un027 | TP53 | P53; BCC7; LFS1; TRP53 | cellular tumor antigen p53 | 191170 | 7157 |
| Un028 | CEACAM3 | CEA; CGM1; W264; W282; CD66D | carcinoembryonic antigen-related cell adhesion molecule 3 | 609142 | 1084 |
| Un029 | PRTN3 | MBN; MBT; NP4; P29; PR3; ACPA; AGP7; NP-4; PR-3; CANCA; C-ANCA | myeloblastin precursor | 177020 | 5657 |
| Un030 Un031 Un046 Un092 | TRRAP | PAF350/400, PAF400, STAF40, TR-AP, Tra1 | transformation/transcription domain associated protein | 603015 | 8295 |
| Un032 | MAGEA12 | CT1.12; MAGE12 | melanoma-associated antigen 12 | 300177 | 4111 |
| Un033 | MAGEA2 | CT1.2; MAGE2; MAGEA2A | melanoma-associated antigen 2 | 300173 | 4101 |
| Un034 | MAGEA9 | CT1.9; MAGE9 | melanoma-associated antigen 9 | 300342 | 4108 |
| Un035 | MAGEC2 | CT10; HCA587; MAGEE1 | melanoma-associated antigen C2 | 300468 | 51438 |
| Un036 | PRAME | MAPE; OIP4; CT130; OIP-4 | melanoma antigen preferentially expressed in tumors | 606021 | 23532 |
| Un037 | SOX10 | DOM; WS4; PCWH; WS2E; WS4C | transcription factor SOX-10 | 602229 | 6663 |
| Un038 | MUC1 | EMA; MCD; PEM; PUM; KL-6; MAM6; MCKD; PEMT; CD227; | mucin-1 | 158340 | 4582 |

TABLE 3-continued

ATLAS melanoma TAA library

| Code | Antigen Name | Alias | Long Name | OMIM | GeneID |
|---|---|---|---|---|---|
| | | H23AG; MCKD1; MUC-1; ADMCKD; ADMCKD1; CA 15-3; MUC-1/X; MUC1/ZD; MUC-1/SEC | | | |
| Un039 | RAC1 | MIG5; Rac-1 TC-25; p21-Rac1 | ras-related C3 botulinum toxin substrate 1 isoform Rac1b | 602048 | 5879 |
| Un040 | HRAS | CTLO; HAMSV; HRAS1; RASH1; p21ras; C-H-RAS; H-RASIDX; C-BAS/HAS; C-HA-RAS1 | GTPase HRas | 190020 | 3265 |
| Un041 | GAGE4 | CT4.4 | G antigen 121 | 300597 | 2576 |
| Un042 | BAGE | BAGE1; CT2.1 | B melanoma antigen 1 precursor | 605167 | 574 |
| Un043 | AR | KD; AIS; AR8; TFM; DHTR; SBMA; HYSP1; NR3C4; SMAX1; HUMARA | androgen receptor | 313700 | 367 |
| Un044 | CYP1B1 | CP1B; GLC3A; CYPIB1; P4501B1 | cytochrome P450 1B1 | 601771 | 1545 |
| Un045 | CA9 | MN; CAIX | carbonic anhydrase 9 precursor | 603179 | 768 |
| Un047 | MMP8 | HNC; CLG1; MMP-8; PMNL-CL | neutrophil collagenase | 120355 | 4317 |
| Un048 | GAGE1 | CT4.1; GAGE-1 | G antigen 1 | 300594 | 2543 |
| Un049 | TYR | ATN; CMM8; OCA1; OCA1A; OCAIA; SHEP3 | tyrosinase precursor | 606933 | 7299 |
| Un050 | HPV_E6 | | HPV E6 oncoprotein | | 1489078 |
| Un051 | Bcr-abl | | BCR/ABL fusion protein e14a5, (peptide atlas A6MFJ9) | | 107963955 |
| Un052 | PDGFRB | IMF1; MGC4; JTK12; PDGFR; CD140B; PDGFR1; PDGFR-1 | platelet-derived growth factor receptor beta | 173410 | 5159 |
| Un053 | KLK3 | KLKB1, KLK3, PSA | Plasma kallikrein | 176820 | 354 |
| Un054 | PAX5 | ALL3; BSAP | paired box protein Pax-5 | 167414 | 5079 |
| Un055 | ST3GAL5 | SATI; SIAT9; ST3GalV; SIATGM3S | lactosylceramide alpha-2,3-sialyltransferase | 604402 | 8869 |
| Un056 | PLAC1 | CT92; OOSP2L | placenta-specific protein 1 precursor | 300296 | 10761 |
| Un057 | PSCA | PRO232 | prostate stem cell antigen preproprotein | 602470 | 8000 |
| Un058 | RhoC | H9; ARH9; ARHC; RHOH9 | rho-related GTP-binding protein RhoC precursor | 165380 | 389 |
| Un059 | MYCN | NMYC; ODED; MODED; N-myc; bHLHe37 | N-myc proto-oncogene protein | 164840 | 4613 |
| Un060 | EpCAM | ESA; KSA; M4S1; MK-1; DIAR5; EGP-2; EGP40; KS1/4; MIC18; TROP1; | epithelial cell adhesion molecule | 185535 | 4072 |

TABLE 3-continued

ATLAS melanoma TAA library

| Code | Antigen Name | Alias | Long Name | OMIM | GeneID |
|---|---|---|---|---|---|
| Un061 | REG3A | EGP314; HNPCC8; TACSTD1 HIP; PAP; PAP1; REG3; INGAP; PAP-H; PBCGF; HIP/PAP; REG-III | regenerating islet-derived protein 3-alpha precursor | 167805 | 5068 |
| Un062 | EphA2 | ECK; CTPA; ARCC2; CTPP1; CTRCT6 | ephrin type-A receptor 2 | 176946 | 1969 |
| Un063 | CSAG2 | TRAG3; CSAG3B; CT24.2; TRAG-3 | chondrosarcoma-associated gene 2/3 protein | | 102723547 |
| Un064 | CTAG2-1a | CT2; ESO2; CAMEL; CT6.2; CT6.2a; CT6.2b; LAGE-1; LAGE2B | cancer/testis antigen 2 isoform LAGE-1a | | 30848 |
| Un065 | PAGE4 | JM27; JM-27; CT16.7; GAGE-9; GAGEC1; PAGE-1; PAGE-4 | P antigen family member 4 | 300287 | 9506 |
| Un066 | BRAF | NS7; BRAF1; RAFB1; B-RAF1 | serine/threonine-protein kinase B-raf | 164757 | 673 |
| Un067 | FAP | FAPA; SIMP; DPPIV | prolyl endopeptidase FAP | 600403 | 2191 |
| Un068 | GRM3 | GLUR3; mGlu3; GPRC1C; MGLUR3 | metabotropic glutamate receptor 3 | 601115 | 2913 |
| Un069 | ERBB4 | HER4; ALS19; p180erbB4 | receptor tyrosine-protein kinase erbB-4 | 600543 | 2066 |
| Un070 | KIT | PBT; SCFR; C-Kit; CD117 | mast/stem cell growth factor receptor Kit | 164920 | 3815 |
| Un071 | LCK | LSK; YT16; IMD22; p56lck; pp58lck | tyrosine-protein kinase Lck | 153390 | 3932 |
| Un072 | MAGEA10 | CT1.10; MAGE10 | melanoma-associated antigen 10 | 300343 | 4109 |
| Un073 | MAGEA4 | CT1.4; MAGE4; MAGE4A; MAGE4B; MAGE-41; MAGE-X2 | melanoma-associated antigen 4 | 300175 | 4103 |
| Un074 | MAGEA6 | CT1.6; MAGE6; MAGE3B; MAGE-3b | melanoma-associated antigen 6 | 300176 | 4105 |
| Un075 | MAPK1 | ERK; p38; p40; p41; ERK2; ERT1; ERK-2; MAPK2; PRKM1; PRKM2; P42MAPK; p41mapk; p42-MAPK | mitogen-activated protein kinase 1 | 176948 | 5594 |
| Un076 | MFI2 | MTf; MTF1; CD228; MAP97 | melanotransferrin | 155750 | 4241 |
| Un077 | SART3 | P100; p110; DSAP1; TIP110; p110(nrb); RP11-13G14 | squamous cell carcinoma antigen recognized by T-cells 3 | 611684 | 9733 |
| Un078 | ST8SIA1 | GD3S; SIAT8; SIAT8A; SIAT8-A; ST8SiaI | alpha-N-acetylneuraminide alpha-2,8-sialyltransferase | 601123 | 6489 |

TABLE 3-continued

ATLAS melanoma TAA library

| Code | Antigen Name | Alias | Long Name | OMIM | GeneID |
|---|---|---|---|---|---|
| Un079 | WDR46 | UTP7; BING4; FP221; C6orf11 | WD repeat-containing protein 46 | 611440 | 9277 |
| Un080 | AKAP-4 | AKAP 82, AKAP-4, AKAP82, CT99, FSC1, HI, PRKA4, hAKAP82, p82, AKAP4 | A-kinase anchoring protein 4 | 300185 | 8852 |
| Un081 | RGS5 | MST092; MST106; MST129; MSTP032; MSTP092; MSTP106; MSTP129 | regulator of G-protein signaling 5 | 603276 | 8490 |
| Un082 | CTAG2-1b | CT2; ESO2; CAMEL; CT6.2; CT6.2a; CT6.2b; LAGE-1; LAGE2B | cancer/testis antigen 2 isoform LAGE-1b | | |
| Un083 | FOSL1 | FRA; FRA1; fra-1 | fos-related antigen 1 | 136515 | 8061 |
| Un084 | PRM2 | MAD-CT-1; CT94.2 | protamine-2 | 182890 | 5620 |
| Un085 | ACRBP | CT23; SP32; OY-TES-1 | acrosin-binding protein precursor | 608352 | 84519 |
| Un086 | AFP | AFPD, FETA, HPAFP | alpha-fetoprotein | 104150 | 174 |
| Un087 | CTCFL | CT27; BORIS; CTCF-T; HMGB1L1; dJ579F20.2 | transcriptional repressor CTCFL | 607022 | 140690 |
| Un088 | CSPG4 | NG2; MCSP; MCSPG; MSK16; HMW-MAA; MEL-CSPG | chondroitin sulfate proteoglycan 4 precursor | 601172 | 1464 |
| Un089 | PAX3 | WS1; WS3; CDHS; HUP2 | paired box protein Pax-3 | 606597 | 5077 |
| Un090 | CCNB1 | CCNB | G2/mitotic-specific cyclin-B1 | 123836 | 891 |
| Un091 | MSLN | Mesotheline; MPF; SMRP | mesothelin | 601051 | 10232 |
| Un093 | EGFR | ERBB; HER1; mENA; ERBB1; PIG61; NISBD2 | epidermal growth factor receptor | 131550 | 1956 |
| Un094 | WT1 | GUD; AWT1; WAGR; WT33; NPHS4; WIT-2; EWS-WT1 | Wilms tumor protein | 607102 | 7490 |
| Un095 | SSX2 | SSX; HD21; CT5.2; CT5.2A; HOM-MEL-40 | protein SSX2 | 300192 | 6757 |
| Un096 | KDR | FLK1; CD309; VEGFR; VEGFR2 | vascular endothelial growth factor receptor 2 precursor | 191306 | 3791 |
| Un097 | ANKRD30A | NY-BR-1 | ankyrin repeat domain-containing protein 30A | 610856 | 91074 |
| Un098 | MAGED1 | NRAGE; DLXIN-1 | melanoma-associated antigen D1 | 300224 | 9500 |
| Un099 | CEACAM5 | CEA; CD66e | carcinoembryonic antigen-related cell adhesion molecule 5 | 114890 | 1048 |
| Un101 | MAP3K9 | MLK1; MEKK9; PRKE1 | mitogen-activated protein kinase kinase kinase 9 | 600136 | 4293 |
| Un102 | XAGE1B | CTP9; XAGE1; CT12.1; GAGED2; XAGE-1; XAGE1A; CT12.1A; CT12.1B | X antigen family member 1 | 300742 | 653220 |
| Un103 | PREX2 | DEP.2; DEPDC2; P- | phosphatidylinositol 3,4,5-trisphosphate-dependent Rac | 612139 | 80243 |

TABLE 3-continued

ATLAS melanoma TAA library

| Code | Antigen Name | Alias | Long Name | OMIM | GeneID |
|---|---|---|---|---|---|
| | | REX2; PPP1R129; 6230420N16Rik | exchanger 2 protein | | |
| Un104 | ERBB2 | NEU; NGL; HER2; TKR1; CD340; HER-2; MLN 19; HER-2/neu | receptor tyrosine-protein kinase erbB-2 | 164870 | 2064 |
| Un105 | CD276 | B7H3; B7-H3; B7RP-2; 4Ig-B7-H3 | CD276 antigen | 605715 | 80381 |
| Un106 | TEK | TIE2; VMCM; TIE-2; VMCM1; CD202B | angiopoietin-1 receptor | 600221 | 7010 |
| Un107 | AIM1 | ST4; CRYBG1 | absent in melanoma 1 protein | 601797 | 202 |
| Un108 | ALK | CD246; NBLST3 | ALK tyrosine kinase receptor | 613014 | 238 |
| Un109 | PSMA | FOLH1 | Glutamate carboxypeptidase 2 | 600934 | 2346 |
| Un110 | GRIN2A | LKS; EPND; FESD; NR2A; GluN2A; NMDAR2A | glutamate receptor ionotropic, NMDA 2A | 138253 | 2903 |
| Un111 | MAP3K5 | ASK1; MEKK5; MAPKKK5 | mitogen-activated protein kinase kinase kinase 5 | 602448 | 4217 |
| Un112 | HPSE1 | | heparanase isoform 1 | 604724 | 10855 |
| Un113 | HPSE2 | | heparanase isoform 2 | 604724 | 10855 |
| Un114 | SAGE | CT14 | sarcoma antigen 1 | 300359 | 55511 |

OMIM = Online Mendelian Inheritance in Man database
GeneID = NCBI database

ATLAS Library Screening

A peripheral blood sample was collected from a consented melanoma patient who had previously undergone therapy with a checkpoint inhibitor (pembrolizumab) and responded to therapy. Peripheral blood mononuclear cells (PBMC) were enriched by density gradient centrifugation. CD4$^+$ and CD8$^+$ T cells were sorted using antibody-conjugated magnetic beads and non-specifically expanded with anti-CD3 and anti-CD28 stimulation. Monocytes were differentiated into dendritic cells (MDDC).

Library clones were screened in replicates using 5,000 MDDC and 80,000 T cells, at an E. coli:MDDC ratio of 100:1. After 24 hours incubation, assay supernatants were harvested and stored at −80° C. Supernatant cytokines were analyzed using a Meso Scale Discovery V-PLEX Proinflammatory Panel 1 (human) Kit.

Data Analysis

Clones that induced mean IFNγ responses that were statistically different from background (Wilcoxon Rank Sum, p<0.05) and exceeded 3 standard deviations (SD) of the mean of the negative control GFP clones (N=10) were considered antigens.

FIG. 1 shows representative results for a single melanoma patient. Clones that induced mean IFNγ responses that were statistically different from background (Wilcoxon Rank Sum, p<0.05) and exceeded 3 standard deviations (SD) of the mean of the negative control GFP clones (N=10) were considered antigens (indicated by horizontal dotted line). CEF=positive control peptide pool. GFP=green fluorescent protein. Each symbol represents an individual measurement, horizontal line=mean. Un022 & Un023 were not included in the CD8$^+$ library.

Example 2. Cohort-Specific T Cell Responses to TAAs Associated with Protective Immunity in Melanoma Patients after Checkpoint Blockade Therapy Dozens of subjects were recruited into the study and cohorted based upon their clinical outcome after checkpoint inhibitor therapy. Subjects who had stable disease or tumor regression were considered protected; those who had worsening disease (tumor growth) were considered not protected. Clinical determinations were made by tumor imaging scans.

Briefly, blood samples were collected from 32 consented melanoma patients who had previously undergone checkpoint inhibitor therapy (one subject had two separate collections). Peripheral blood mononuclear cells (PBMC) were enriched by density gradient centrifugation. CD4$^+$ and CD8$^+$ T cells were sorted and non-specifically expanded using anti-CD3 and anti-CD28-coated microbeads, and CD14$^+$ monocytes were differentiated into dendritic cells (MDDC). Library clones comprising known TAAs (labelled as Un001-023, as shown above in Table 3) were screened in duplicate using 5,000 MDDC and 80,000 T cells, at an E. coli:MDDC ratio of 100:1; ten replicates of E. coli expressing GFP were included as negative controls. Assay supernatants were harvested at 24 hours and stored at −80° C. Supernatant cytokines were analyzed using Meso Scale Discovery V-PLEX Proinflammatory Panel 1 (human) Kit.

Data Analysis

Clones that induced mean cytokine responses that were statistically different from background (Wilcoxon Rank Sum, p<0.05) and exceeded 3 standard deviations (SD) of the mean responses to the negative control GFP clones (N=10) were considered antigens. The mean number of antigens to which each cohort responded with each cytokine were compared to determine if differences existed between protected (Responder) and non-protected (Non-responder) cohort.

Figure 2:
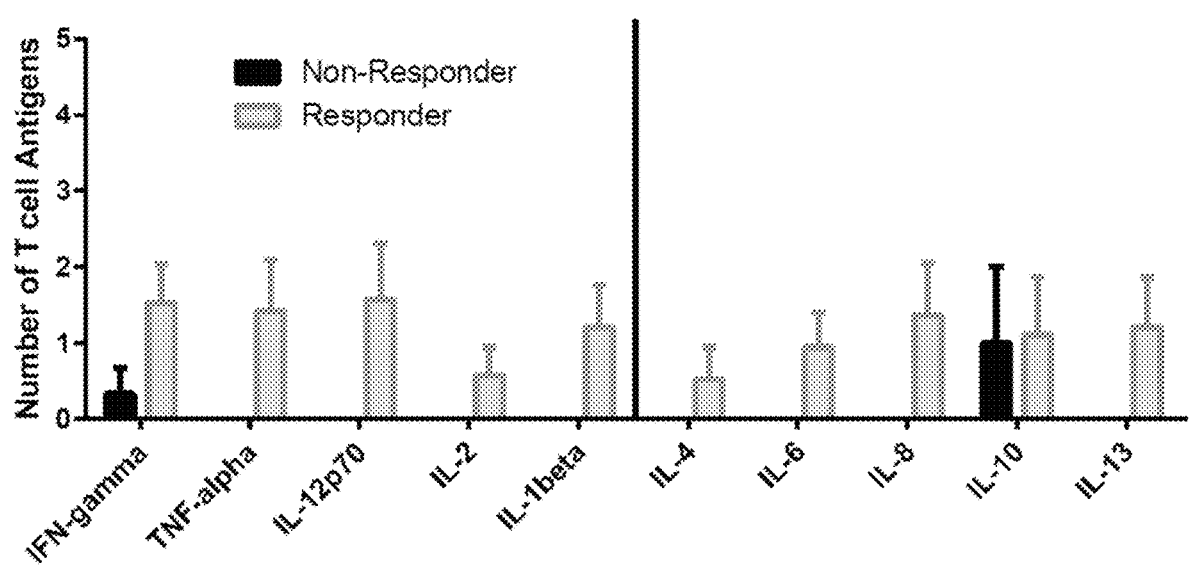
FIG. 2 is a graph showing the number of T cell antigens that stimulated cytokine secretion in supernatants by CD4+ T cells from melanoma patients who were non-responders or responders to immune checkpoint blockade therapy. The T cells were co-cultured with autologous antigen presenting cells pulsed with E. coli expressing various tumor associated antigens.

FIG. 2 shows cohort data for the CD4+ T cell subset. Subjects were cohorted into "Responder" (gray bars) or "Non-Responder" (black bars) groups based on clinical evaluation of disease. Using a cutoff of 3 SD above the mean of the negative control response per patient for each cytokine evaluated, the number of TAAs to which each subject responded with their CD4+ T cell subset is represented. In contrast to the Responder cohort, the Non-Responder group had minimal discernable CD4+ T cell responses, by the majority of cytokines evaluated, to any of the TAAs included in the library. Data are shown as the mean number (±SE) of TAAs to which each cohort responded with each cytokine measured.

Figure 3:
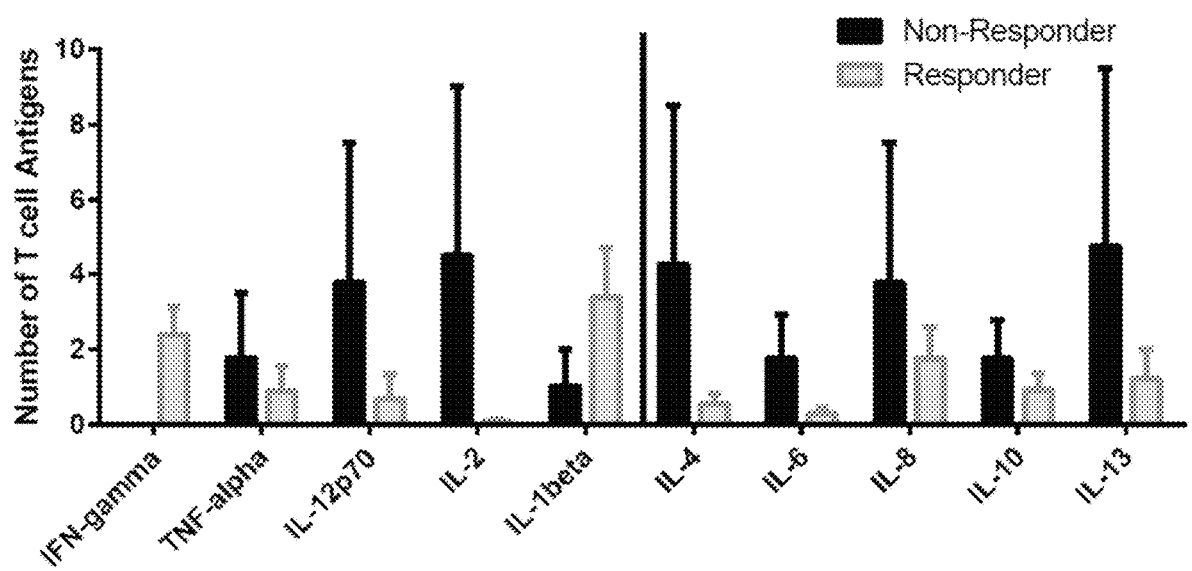
FIG. 3 is a graph showing the number of T cell antigens that stimulated cytokine secretion in supernatants by CD8+ T cells from melanoma patients who were non-responders or responders to immune checkpoint blockade therapy. The T cells were co-cultured with autologous antigen presenting cells pulsed with E. coli expressing various tumor-associated antigens.

FIG. 3 shows cohort data for the CD8+ T cell subset. Subjects were cohorted into "Responder" (gray bars) or "Non-Responder" (black bars) groups based on clinical evaluation of disease. Using a cutoff of 3 SD above the mean of the negative control response per patient for each cytokine evaluated, the number of TAAs to which each subject responded with their CD8+ T cell subset is represented. CD8+ T cells secreting IFNγ were undetectable in Non-Responders, but Responders had responses to a mean of ~two TAAs. Data are shown as the mean number (±SE) of TAAs to which each cohort responded with each cytokine measured.

Example 3. Immune Responses to Neoantigens Identified Using ATLAS in a Non-Small Cell Lung Cancer (NSCLC) Patient Generation of the ATLAS Neoantigen Library ATLAS (Genocea Biosciences) was applied to screen the entire complement of mutations identified in the tumor of a consented NSCLC patient who was successfully treated with pembrolizumab (αPD-1 antibody (Ab), every other week starting on day 0). An ATLAS library was built that expressed 201 of 202 mutations unique to this patient. Each clone contained 113 amino acids with the mutation positioned near the center of the construct and sequence-verified. Each clone was recombinantly expressed in E. coli. Protein expression was verified using a surrogate T cell assay (the B3Z hybridoma) which recognizes the C57BL/6 mouse T cell epitope SIINFEKL (SEQ ID NO: 452), which is inserted at the C-terminus of each open reading frame, upstream of the stop codon. Proteins that induced B3Z responses that exceeded 5% of the positive control (the minimal SIINFEKL (SEQ ID NO: 452) epitope pulsed onto antigen presenting cells) were considered expressed.

ATLAS Library Screening

Peripheral blood samples were collected from the NSCLC patient before and after checkpoint blockade therapy. Peripheral blood mononuclear cells (PBMC) were enriched by density gradient centrifugation. CD4+ and CD8+ T cells were sorted using antibody-conjugated magnetic beads and non-specifically expanded with anti-CD3 and anti-CD28 stimulation. Monocytes were differentiated into dendritic cells (MDDC).

CD4+ and CD8+ T cells from Day 0 and Day 42 (after 3$^{rd}$ injection) of treatment were screened, respectively, against 195 and 201 of the 201 library clones, as well as against 20 negative control clones expressing Neon Green (NG). Library clones were screened in duplicate using 2,000 MDDC and 80,000 T cells, at an E. coli:MDDC ratio of 250:1. After 24 h incubation, assay supernatants were harvested and stored at −80° C. Supernatant cytokines were analyzed using a Meso Scale Discovery V-PLEX Proinflammatory Panel 1 (human) Kit.

Data Analysis

Clones that induced mean cytokine responses that were statistically different from background (Wilcoxon Rank Sum, p<0.05) and exceeded 3 standard deviations (SD) of the mean responses to the negative control Neon Green clones (N=20) were considered antigens (indicated by horizontal dotted line).

Figure 4:
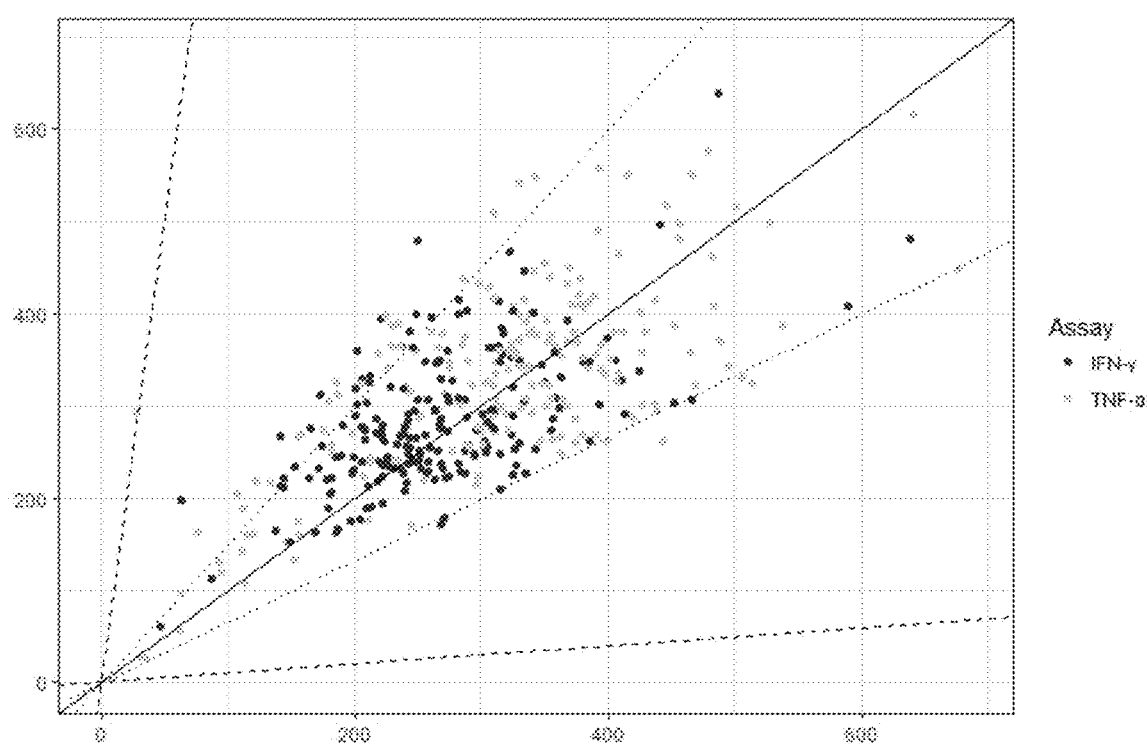
FIG. 4 is a scatter plot showing good alignment between replicate measurements for cytokines secreted by T cells from a representative NSCLC patient after stimulation by autologous antigen presenting cells pulsed with E. coli expressing putative neoantigens.

FIG. 4 shows good alignment between duplicate measurements of the cytokines IFNγ and TNFα for CD8+ T cell response, with over 74% of replicates falling within 1.5-fold of one another.

Figure 5:
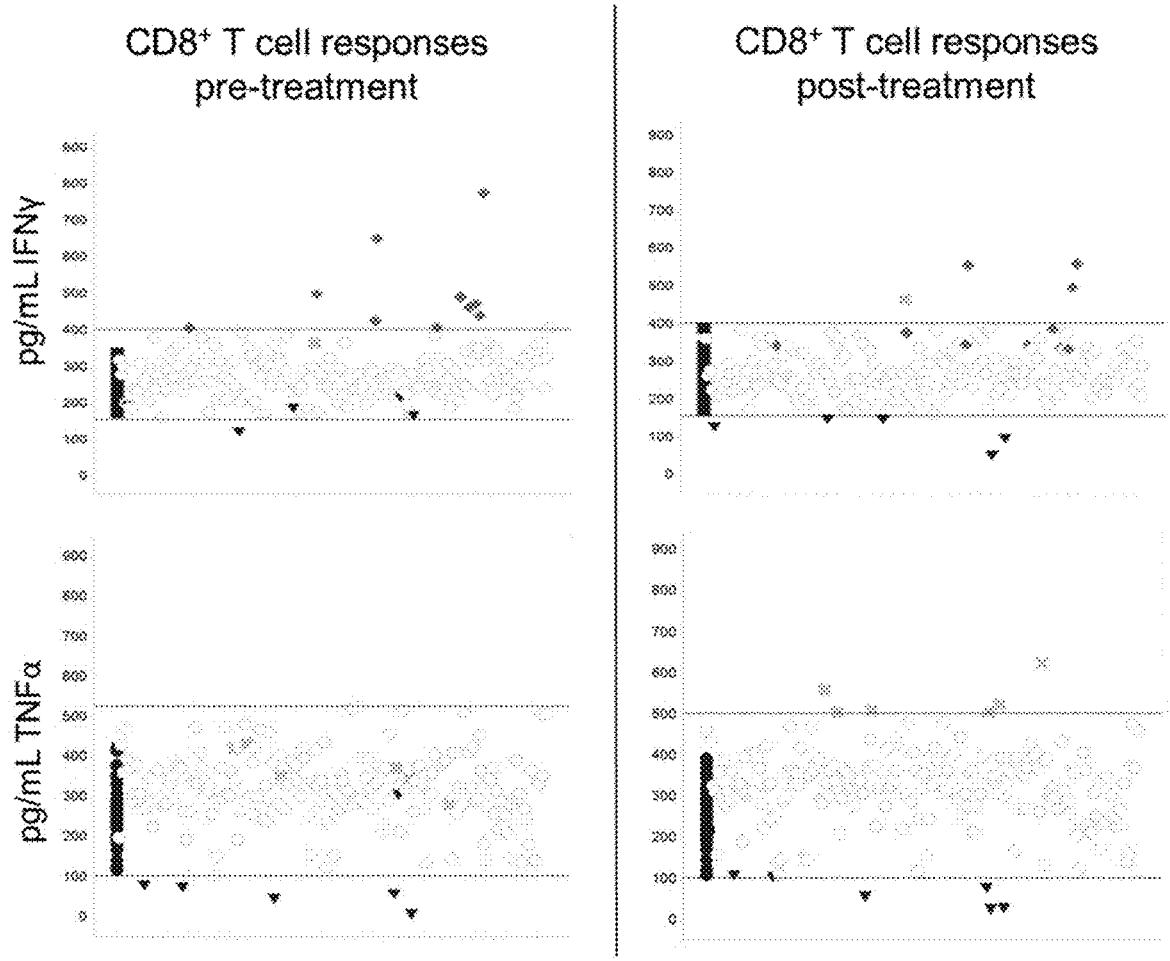
FIG. 5 is a graph showing results for IFNγ and TNFα secretion from CD8+ T cells from a representative NSCLC patient, collected pre- and post-checkpoint blockade therapy, after co-culture with autologous antigen presenting cells pulsed with E. coli expressing putative neoantigens.

FIG. 5 shows results for IFNγ and TNFα for CD8+ T cells pre- and post-treatment (left and right panels respectively). In this NSCLC patient, 5% of mutations screened (9 of 201) were identified as neoantigens recognized by his/her peripheral blood CD8+ T cells taken pre- and post-treatment. Only 1% of the identified neoantigens were found both pre- and post-treatment. Points above the top dotted line indicate neoantigens that stimulate CD8+ T cell responses. Points below the lower dotted line indicate neoantigens that suppress and/or inhibit CD8+ T cell responses.

Figure 6:
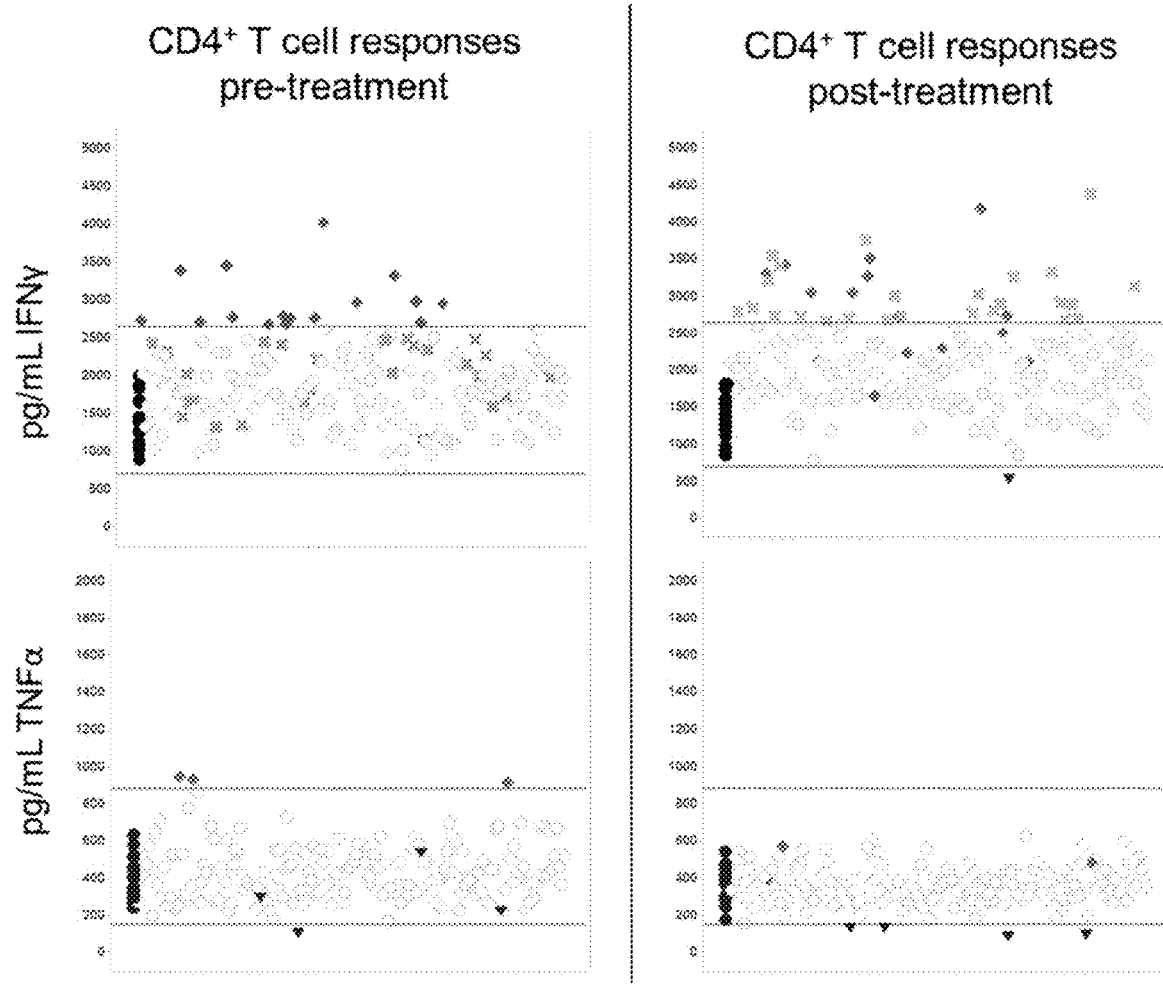
FIG. 6 is a graph showing results for IFNγ and TNFα secretion from CD4+ T cells from a representative NSCLC patient, collected pre- and post-checkpoint blockade therapy, after co-culture with autologous antigen presenting cells pulsed with E. coli expressing putative neoantigens.

FIG. 6 shows results for IFNγ and TNFα for CD4+ T cells pre- and post-treatment (left and right panels respectively). In this NSCLC patient, 10% of mutations screened (20 of 195) were identified as neoantigens recognized by his/her peripheral blood CD4+ T cells taken pre-treatment, increasing to 17% of mutations screened (33 of 195) post-treatment. Five percent of the identified neoantigens were found both pre- and post-treatment. Points above the top dotted line indicate neoantigens that stimulate CD4+ T cell responses. Points below the lower dotted line indicate neoantigens that suppress and/or inhibit CD4+ T cell responses. These results show increased breadth of CD4+ T cell responses to neoantigens following checkpoint inhibitor therapy, particularly with respect to IFNγ.

Table 4 summarizes results shown in FIGS. 5 and 6.

| T cell responses | Pre-treatment | Post-treatment | Both |
|---|---|---|---|
| CD8+ | 5% | 5% | 1% |
| CD4+ | 10% | 17% | 5% |

Figure 7:
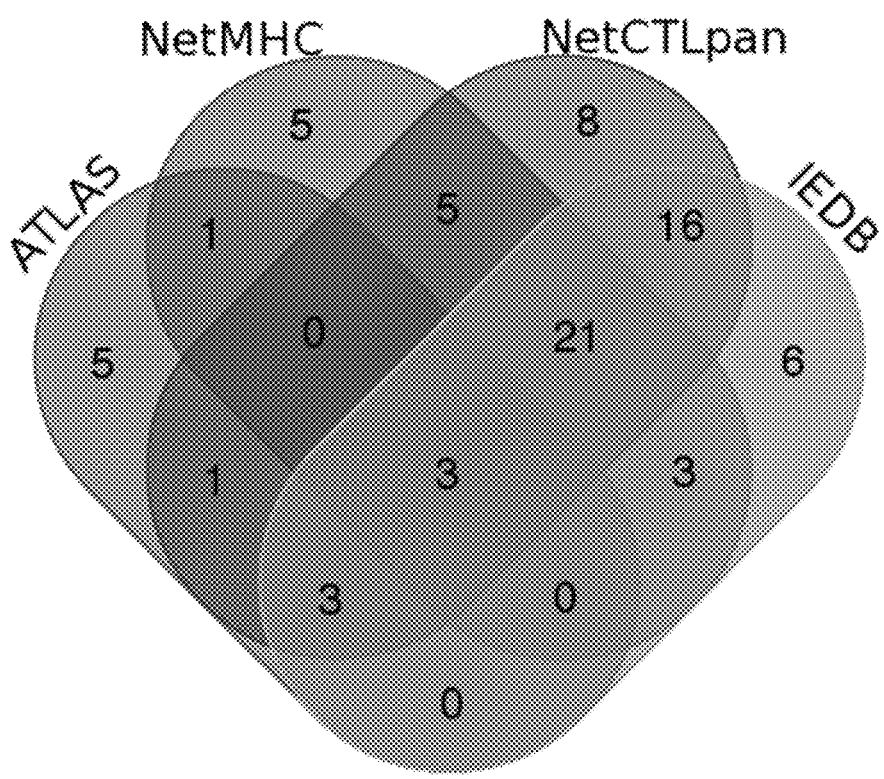
FIG. 7 is a Venn diagram showing limited overlap between CD8+-specific T cell neoantigens from a representative NSCLC patient, identified using methods of the disclosure and epitope prediction algorithms.

FIG. 7 shows the limited overlap between CD8+-specific T cell neoantigens identified by ATLAS and epitope prediction algorithms. MHC class I epitopes were predicted for all screened neoantigens from the NSCLC patient using three commonly used algorithms: NetMHC, NetCTLpan and IEDB, and using patient-specific haplotypes HLA-A*02:01/*32:01, HLA-B*40:01:02/*45:01:01, HLAC*06:02/*03:041 (see Rizvi et al., (2015) Science. 348(6230): 124-8). Eight of the antigens identified by ATLAS were not predicted by any of NetMHC, NetCTLpan, or IEDB. (Note that MHC class II epitopes cannot be effectively predicted using currently available algorithms.)

Figure 8:
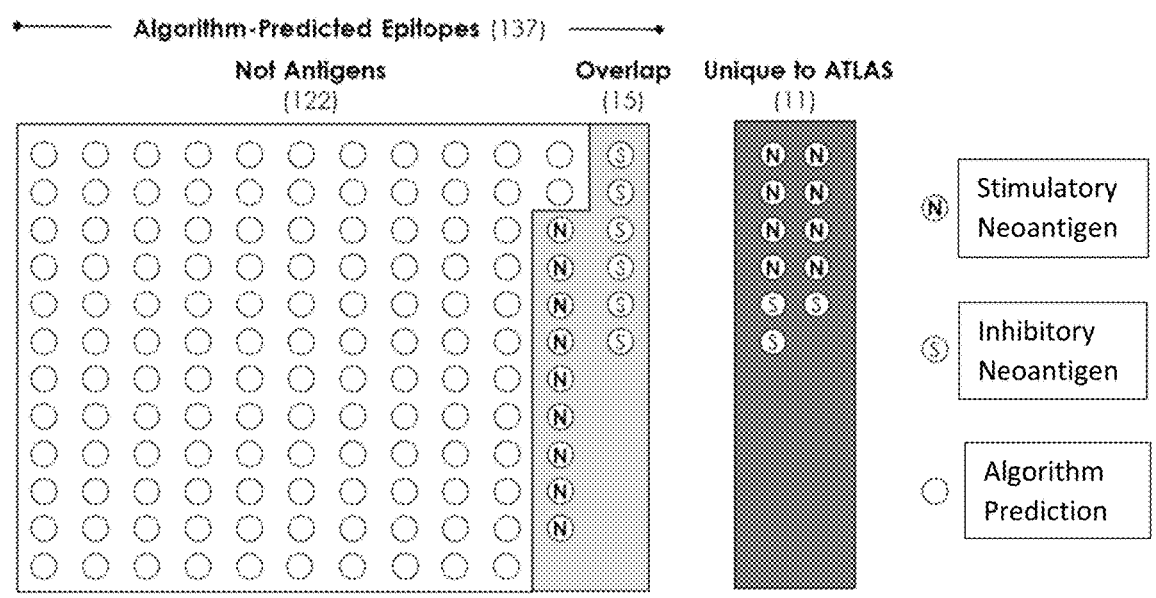
FIG. 8 is a schematic showing epitope predictions had a high false positive rate, missed relevant antigens and failed to identify suppressive and/or inhibitory neoantigens.

FIG. 8 further shows that epitope predictions have a high false positive rate, miss relevant stimulatory neoantigens, and are not able to identify suppressive and/or inhibitory neoantigens. Of the 137 neoantigens predicted by at least one algorithm, only 15 (or 11%) were confirmed by ATLAS to effect a CD8+ T cell response in the NSCLC patient. Six of these 15 neoantigens were found to be suppressive and/or inhibitory. Altogether, ATLAS identified 9+8 stimulatory neoantigens, and 6+3 suppressive and/or inhibitory neoantigens. Thus, 47% of stimulatory antigens found by ATLAS were missed by algorithms, and 33% of suppressive and/or inhibitory neoantigens found by ATLAS failed to be identified by algorithms.

Example 4. Immune Responses to the ATLAS Colorectal Cancer (CRC) Tumor Associated Antigen (TAA) Library—Single Patient Response Generation of the ATLAS Colorectal Cancer TAA Library Twenty-six TAA genes (representing 23 unique genes; labelled as "taa1-26" and shown below in Table 5) were cloned into the ATLAS expression vector (Genocea Biosciences), and sequence-verified. Each TAA was recombinantly expressed in E. coli. Protein expression was verified using a surrogate T cell assay (the B3Z hybridoma) which recognizes the C57BL/6 mouse T cell epitope SIINFEKL (SEQ ID NO: 452), which is inserted at the C-terminus of each open reading frame, upstream of the stop codon. Proteins that induced B3Z responses that exceeded 5% of the positive control (the minimal SIINFEKL (SEQ ID NO: 452) epitope pulsed onto antigen presenting cells) were considered expressed.

ATLAS Library Screening

A frozen peripheral blood mononuclear cell (PBMC) vial was purchased from Bioreclamation IVT. The PBMC were derived from a 50 year-old Caucasian male who had stage IV colorectal cancer. CD8+ T cells were sorted using antibody-conjugated magnetic beads and non-specifically expanded with anti-CD3 and anti-CD28 stimulation. Monocytes were differentiated into dendritic cells (MDDC).

Library clones were screened in replicates using 5,000 MDDC and 80,000 T cells, at an E. coli:MDDC ratio of 100:1. After 24 h incubation, assay supernatants were harvested and stored at −80° C. Negative controls included 13 replicates of E. coli expressing neon green (NG). Supernatant cytokines were analyzed using a Meso Scale Discovery V-PLEX Proinflammatory Panel 1 (human) Kit.

Data Analysis

Measurements that were below the lower limit of detection for the standard curve of each cytokine were masked. Clones that induced mean IFNγ or TNFα responses that exceeded 3 standard deviations (SD) of the mean of the negative control neon green (NG) clones (N=13) were considered antigens.

Figure 9:
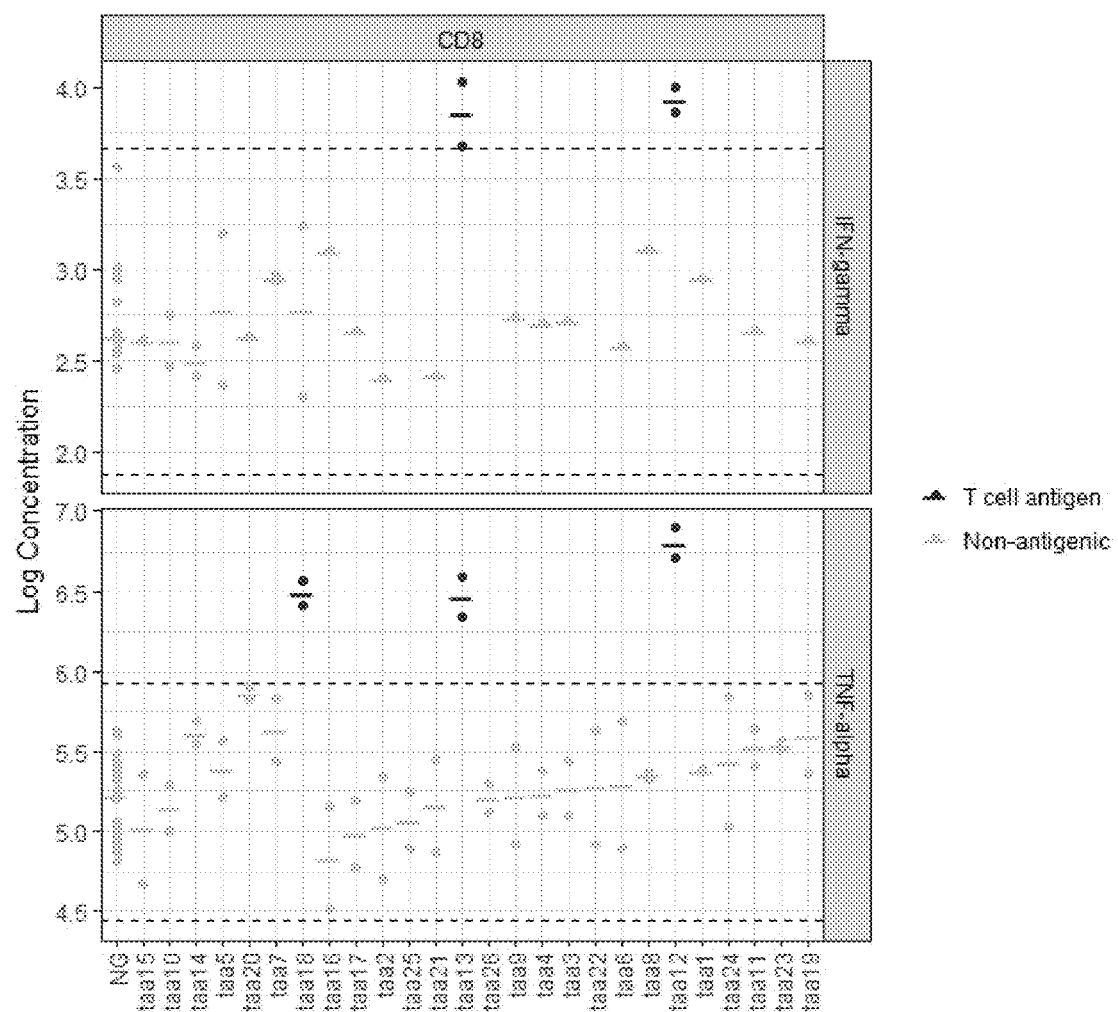
FIG. 9 is a graph showing IFNγ and TNF-α secreted in supernatants by T cells from a representative patient with colorectal cancer. The T cells were co-cultured with autologous antigen presenting cells pulsed with E. coli expressing various tumor-associated antigens. NG=neon green.

FIG. 9 shows representative results for a single CRC patient. Clones that induced mean IFNγ and/or TNFα responses that exceeded 3 standard deviations (SD) of the mean of the negative control NG clones (N=10) were considered antigens (indicated by horizontal dotted line, black symbols). NG=neon green. Each symbol represents an individual measurement, small horizontal line=mean of duplicate measurements. TAA coding conventions are shown in Table 5 below.

Example 5. T Cell Responses to CRC TAAs in a Cohort of CRC Patients

PBMC from 21 CRC patients were screened against a library of 26 known TAAs (shown in Table 5). CD4+ and CD8+ T cells were sorted and non-specifically expanded using anti-CD3 and anti-CD28-coated microbeads, and CD14+ monocytes were differentiated into dendritic cells (MDDC). Library clones were screened in duplicate using 5,000 MDDC and 80,000 T cells, at an E. coli:MDDC ratio of 100:1; 13 replicates of E. coli expressing neon green (NG) were included as negative controls. Assay supernatants were harvested at 24 hours and stored at −80° C. Supernatant cytokines were analyzed using Meso Scale Discovery V-PLEX Proinflammatory Panel 1 (human) Kit.

Data Analysis

Clones that induced mean cytokine responses that exceeded 3 standard deviations (SD) of the mean responses to the negative control NG clones (N=10) were considered antigens.

Figure 10:
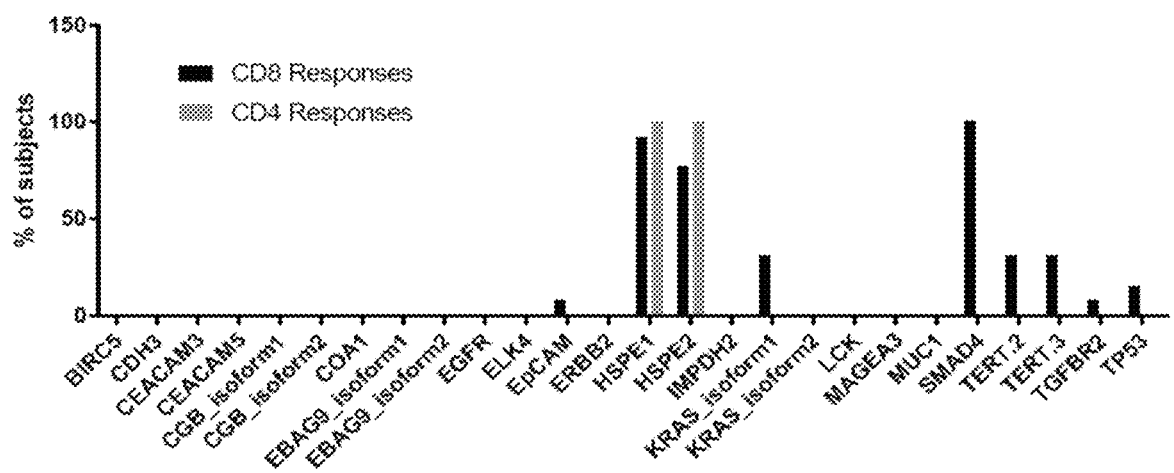
FIG. 10 is a graph showing the percentage of colorectal cancer patients who responded to each TAA, as measured by IFNγ secretion that exceeded three standard deviations of the mean negative control response.

FIG. 10 shows data for both the CD4+ (grey bars) and CD8+ (black bars) T cell subsets. The percentage of subjects who responded to each TAA, as measured by IFNγ secretion that exceeded three standard deviations of the mean negative control (NG) response, is represented. Overall, nine of 26 antigens induced a CD8+ T cell response from at least one of the CRC patients. Three TAAs (HPSE1, HPSE2, SMAD4) were antigens for CD8+ T cells from nearly all subjects screened; two TAAs (HPSE1, HPSE2) were also antigens for each subject's CD4+ T cell subset. Results are summarized in Table 5 below.

Table 5:

TABLE 5

Summary of T cell response rates to TAAs in the ATLAS colorectal cancer library

| Code | TAA | CD4 | CD8 |
| --- | --- | --- | --- |
| taa1 | BIRC5 | 0 | 0 |
| taa2 | CDH3 | 0 | 0 |
| taa3 | CEACAM3 | 0 | 0 |
| taa4 | CEACAM5 | 0 | 0 |
| taa5 | CGB_5 | 0 | 0 |
| taa6 | COA1 | 0 | 0 |
| taa7 | EBAG9 | 0 | 0 |
| taa8 | EGFR | 0 | 0 |
| taa9 | ELK4 | 0 | 0 |
| taa10 | ERBB2 | 0 | 0 |
| taa11 | EpCAM | 0 | 8% |
| taa12 | HPSE1 | 100% | 92% |
| taa13 | HPSE2 | 100% | 77% |
| taa14 | KRAS_isoform1 | 0 | 31% |
| taa15 | KRAS_isoform2 | 0 | 0 |
| taa16 | MAGEA3 | 0 | 0 |
| taa17 | MUC1 | 0 | 0 |
| taa18 | SMAD4 | 0 | 100% |
| taa19 | TERT.2 | 0 | 31% |
| taa20 | TERT.3 | 0 | 31% |
| taa21 | TGFBR2 | 0 | 8% |
| taa22 | EBAG9_isoform1 | 0 | 0 |
| taa23 | TP53 | 0 | 15% |
| taa24 | CGB_3 | 0 | 0 |
| taa25 | IMPDH2 | 0 | 0 |
| taa26 | LCK | 0 | 0 |

Example 6. Immune Responses to Neoantigens Identified Using ATLAS in a Colorectal Cancer (CRC) Patient Generation of the ATLAS Neoantigen Library ATLAS was applied to screen the entire complement of mutations identified in the tumor of a consented colorectal cancer patient. An ATLAS library was built that expressed 31 mutations unique to this patient. Each clone contained 113 amino acids with the mutation positioned near the center of the construct and sequence-verified. Each clone was recombinantly expressed in E. coli and protein expression was verified using Western Blot.

ATLAS Library Screening

Frozen peripheral blood mononuclear cells (PBMC) were purchased from Conversant Bio. After thaw, CD8+ T cells were sorted using antibody-conjugated magnetic beads and non-specifically expanded with anti-CD3 and anti-CD28 stimulation. CD14+ monocytes were also sorted using antibody-conjugated magnetic beads and differentiated in vitro into dendritic cells (MDDC).

CD8+ T cells were screened against the 31 library clones, as well as against 2 negative control clones expressing Neon Green (NG). Library clones were screened using 1,500 MDDC and 80,000 T cells, at an *E. coli*:MDDC ratio of 333:1. After 24 h incubation, assay supernatants were harvested and stored at −80° C. Supernatant cytokines were analyzed using a Meso Scale Discovery custom plate.

Data Analysis

Clones that induced median cytokine responses that exceeded 3 median absolute deviations (MAD) of the median responses to the negative control Neon Green clones (N=2) (indicated by horizontal dotted line in FIG. 11) were considered antigens. Clones that reduced median cytokine responses to 3 MAD below the median negative control responses were considered inhibitory and/or suppressive antigens.

Figure 11:
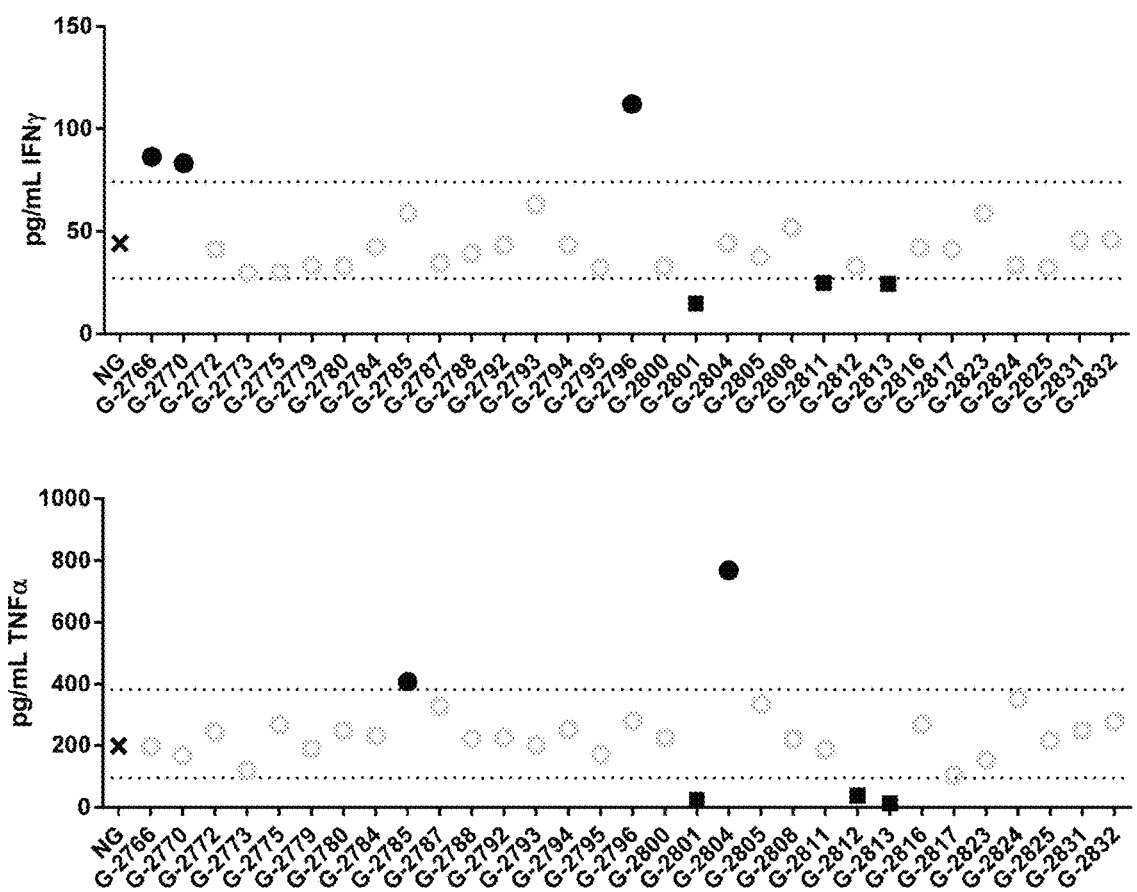
FIG. 11 is a graph showing results for IFNγ and TNF-α secretion from CD8+ T cells from a patient with colorectal carcinoma after co-culture with antigen presenting cells pulsed with E. coli expressing 31 mutations unique to the patient.

FIG. 11 shows results for IFNγ and TNFα from the patient's CD8+ T cells. The X indicates the median response to the negative controls. Points above the top dotted line indicate neoantigens that stimulate CD8+ T cell responses (black circles). Points below the lower dotted line indicate neoantigens that inhibit and/or suppress CD8+ T cell responses (black squares). In this patient, 16% of mutations screened (5 of 31) were identified as neoantigens recognized by his/her peripheral blood CD8+ T cells. Additionally, 13% (4 of 31) of mutations screened were identified as inhibitory and/or suppressive neoantigens. There was no overlap of the neoantigens that induced IFNγ compared with TNFα, but two of the inhibitory neoantigens suppressed both IFNγ and TNFα.

Figure 12A:
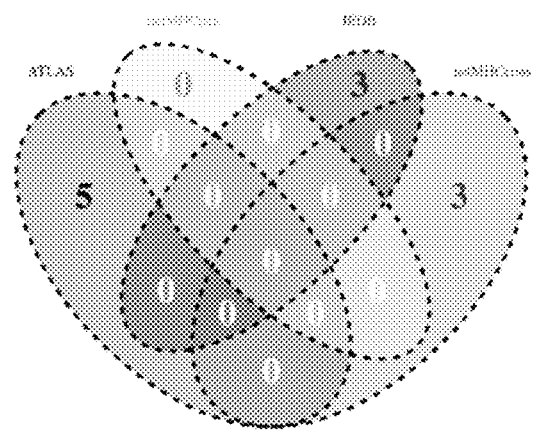
FIGS. 12A and 12B are Venn diagrams representing the limited overlap between CD8+-specific T cell neoantigens identified by ATLAS and epitope prediction algorithms.
Figure 12B:
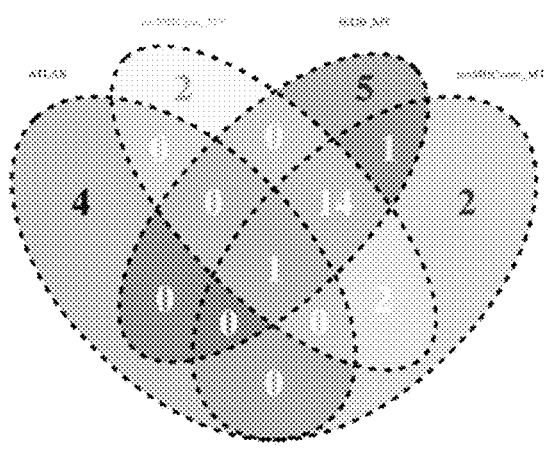

FIGS. 12A and 12B show Venn diagrams representing the limited overlap between CD8+-specific T cell neoantigens identified by ATLAS and epitope prediction algorithms. MHC class I epitopes were predicted for all screened neoantigens using three commonly used algorithms: NetMHC, NetCTLpan and IEDB, and using patient-specific haplotypes HLA-A*30:02/*32:01, B*18:01/*14:01, C*05:01/*08:02. FIG. 12A represents epitopes predicted that had binding affinity projected to be below 500 nM for the mutant peptide (neoantigen) but not for its wild-type counterpart, and an IEDB percentile rank of ≤1 for the mutant peptide but not for wild-type. FIG. 12B represents epitopes predicted to have binding affinity below 500 nM or an IEDB percentile rank of ≤1, irrespective of the wild-type counterpart predictions. In the former case, none of the neoantigens that were identified by ATLAS were predicted by algorithms, and there were six epitopes predicted that were not identified empirically (100% false positive and 100% false negative rate). For the latter, there was one neoantigen that was identified using ATLAS that was also predicted by all three algorithms used. The remaining four neoantigens were not predicted by any algorithm. There were 26 epitopes predicted that could not be confirmed by ATLAS (therefore the algorithms had a 96% false positive rate and an 80% false negative rate).

Figure 13A:
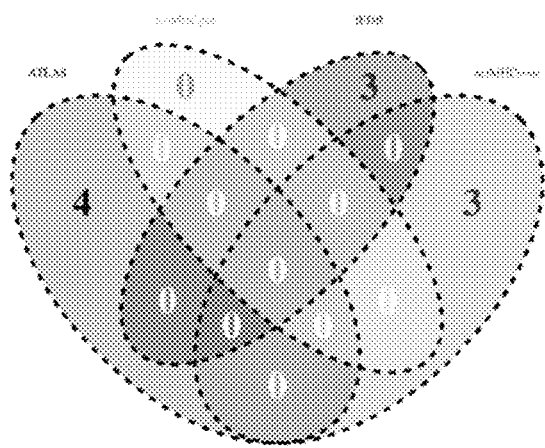
FIGS. 13A and 13B are Venn diagrams representing the limited overlap between CD8+-specific T cell inhibitory and/or suppressive neoantigens identified by ATLAS and epitope prediction algorithms.
Figure 13B:
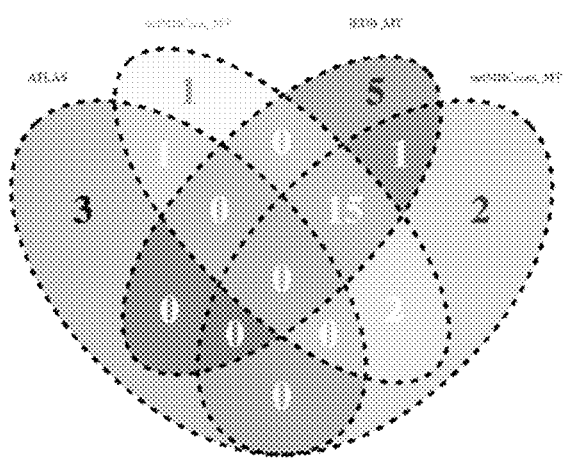

FIGS. 13A and 13B show Venn diagrams representing the limited overlap between CD8+-specific T cell inhibitory and/or suppressive neoantigens identified by ATLAS and epitope prediction algorithms. Epitope predictions do not discriminate between stimulatory or inhibitory and/or suppressive antigens, therefore the same MHC predictions used for FIGS. 12A and 12B were applied for the inhibitory and/or suppressive, rather than stimulatory neoantigens. FIG. 13A represents epitopes predicted that had binding affinity projected to be below 500 nM for the mutant peptide (neoantigen) but not for its wild-type counterpart, and an IEDB percentile rank of ≤1 for the mutant peptide but not for wild-type. FIG. 13B represents epitopes predicted to have binding affinity below 500 nM or an IEDB percentile rank of ≤1, irrespective of the wild-type counterpart predictions. In the former case, none of the inhibitory and/or suppressive neoantigens that were identified by ATLAS were predicted by algorithms, and there were six epitopes predicted that were not identified empirically (100% false positive and 100% false negative rate). For the latter, there was one neoantigen that was identified using ATLAS that was also predicted by one of the three algorithms (netMHCpan_MT). The remaining three neoantigens identified empirically with ATLAS were not predicted by any algorithm. Once again, there were 26 epitopes predicted that could not be confirmed by ATLAS.

Example 7. T Cell Response Profiling in Colorectal Carcinoma Patients Reveals an Enrichment in Responses to Specific Tumor-Associated Antigens Generation of an ATLAS Tumor Associated Antigen Library ATLAS™ was applied to profile T cell recall responses to a set of Tumor Associated Antigens (TAAs) in 34 subjects with various stages of CRC and pre-malignant lesions in an HLA-independent manner. Twenty-six TAA genes (representing 23 unique genes, shown in Table 5) were cloned into the ATLAS expression vector and sequence verified. Each TAA was recombinantly expressed in *E. coli*, with expression verified using Western Blot analysis.

TABLE 6

ATLAS colorectal cancer TAA library

| Antigen Name | Alias | long name | OMIM | GeneID |
|---|---|---|---|---|
| CDH3 | CDHP, HJMD, PCAD | cadherin 3 | 114021 | 1001 |
| CEACAM3 | CEA; CGM1; W264; W282; CD66D | carcinoembryonic antigen-related cell adhesion molecule 3 | 609142 | 1084 |
| CEACAM5 | CEA; CD66e | carcinoembryonic antigen-related cell adhesion molecule 5 | 114890 | 1048 |
| CGB_3 | CGB, CGB5, CGB7, CGB8, hCGB | chorionic gonadotropin beta subunit 3 | 118860 | 1082 |
| CGB_5 | CGB, HCG, hCGB | chorionic gonadotropin beta subunit 5 | 608825 | 93659 |
| COA1 | C7orf44, MITRAC15 | cytochrome c oxidase assembly factor 1 homolog | 614769 | 55744 |

TABLE 6-continued

ATLAS colorectal cancer TAA library

| Antigen Name | Alias | long name | OMIM | GeneID |
|---|---|---|---|---|
| EBAG9 | EB9, PDAF | estrogen receptor binding site associated, antigen, 9 | 605772 | 9166 |
| EGFR | ERBB; HER1; mENA; ERBB1; PIG61; NISBD2 | epidermal growth factor receptor | 131550 | 1956 |
| ELK4 | SAP1 | ETS transcription factor | 600246 | 2005 |
| EpCAM | ESA; KSA; M4S1; MK-1; DIAR5; EGP-2; EGP40; KS1/4; MIC18; TROP1; EGP314; HNPCC8; TACSTD1 | epithelial cell adhesion molecule precursor | 185535 | 4072 |
| ERBB2 | NEU; NGL; HER2; TKR1; CD340; HER-2; MLN 19; HER-2/neu | receptor tyrosine-protein kinase erbB-2 | 164870 | 2064 |
| HPSE1 | | heparanase isoform 1 | 604724 | 10855 |
| HPSE2 | | heparanase isoform 2 | | |
| IMPDH2 | IMPD2, IMPDH-II | inosine monophosphate dehydrogenase 2 | 146691 | 3615 |
| KRAS | C-K-RAS, CFC2, K-RAS2A, K-RAS2B, K-RAS4A, K-RAS4B, K-Ras, K | KRAS proto-oncogene, GTPase | 190070 | 3845 |
| LCK | LSK; YT16; IMD22; p56lck; pp58lck | tyrosine-protein kinase Lck | 153390 | 3932 |
| MAGEA3 | HIP8; HYPD; CT1.3; MAGE3; MAGEA6; MAGE-A3 (G-2544) | MAGE family member A3 | 300174 | 4102 |
| MUC1 | EMA; MCD; PEM; PUM; KL-6; MAM6; MCKD; PEMT; CD227; H23AG; MCKD1; MUC-1; ADMCKD; ADMCKD1; CA 15-3; MUC-1/X; MUC1/ZD; MUC-1/SEC | mucin-1 isoform 14 precursor | 158340 | 4582 |
| SMAD4 | DPC4, JIP, MADH4, MYHRS | SMAD family member 4 | 600993 | 4089 |
| BIRC5 | API4; EPR-1; survivin, BIRC5 | survivin | 603352 | 332 |
| TERT | TP2; TRT; CMM9; EST2; TCS1; hTRT; DKCA2; DKCB4; hEST2; PFBMFT1 | telomerase reverse transcriptase | 187270 | 7015 |
| TGFBR2 | AAT3, FAA3, LDS1B, LDS2, LDS2B, MFS2, RIIC, TAAD2, TGFR-2, | transforming growth factor beta receptor 2 | 190182 | 7048 |
| TP53 | P53; BCC7; LFS1; TRP53 | cellular tumor antigen p53 | 191170 | 7157 |

OMIM = Online Mendelian Inheritance in Man database
GeneID = NCBI database

ATLAS Library Screening

Frozen peripheral blood mononuclear cells (PBMC) were purchased from Conversant Bio (Alabama) or obtained from a collaborator at Mayo Clinic. After thaw, CD8+ T cells were sorted using antibody-conjugated magnetic beads and non-specifically expanded with anti-CD3 and anti-CD28 stimulation. CD14+ monocytes were also sorted using antibody-conjugated magnetic beads and differentiated in vitro into dendritic cells (MDDCs).

Frozen peripheral blood mononuclear cells (PBMC) were purchased from Conversant Bio (Alabama) or obtained from a collaborator at Mayo Clinic. After thaw, CD8+ T cells were sorted using antibody-conjugated magnetic beads and non-specifically expanded with anti-CD3 and anti-CD28 stimulation. CD14+ monocytes were also sorted using antibody-conjugated magnetic beads and differentiated in vitro into dendritic cells (MDDCs).

CD4+ and CD8+ T cells were screened against the 26 library clones, as well as against 10 negative control clones expressing Neon Green (NG). Library clones were screened using 1,000-5,000 MDDCs and 80,000 T cells, at an E. coli:MDDC ratio of 333:1. After 24 h incubation, assay supernatants were harvested and stored at −80° C. Supernatant cytokines levels were analyzed using a Meso Scale Discovery custom plate.

Data Analysis

Clones that induced median cytokine responses that exceeded 2 median absolute deviations (MAD) of the median responses to the negative control Neon Green (NG) clones (N=10) (indicated by a vertical dotted line in FIG. 14 and a horizontal dotted line in FIG. 17) were considered antigens. Clones that reduced median cytokine responses to 2 MAD below the median negative control responses were considered inhibitory and/or suppressive antigens. In CRC patients, the breadth of recall responses to the 26 tested TAAs varied, but there was a strong enrichment of CD4+ and CD8+ T cell responses to a subset of 3 TAAs, which was absent in healthy individuals.

Figure 14:
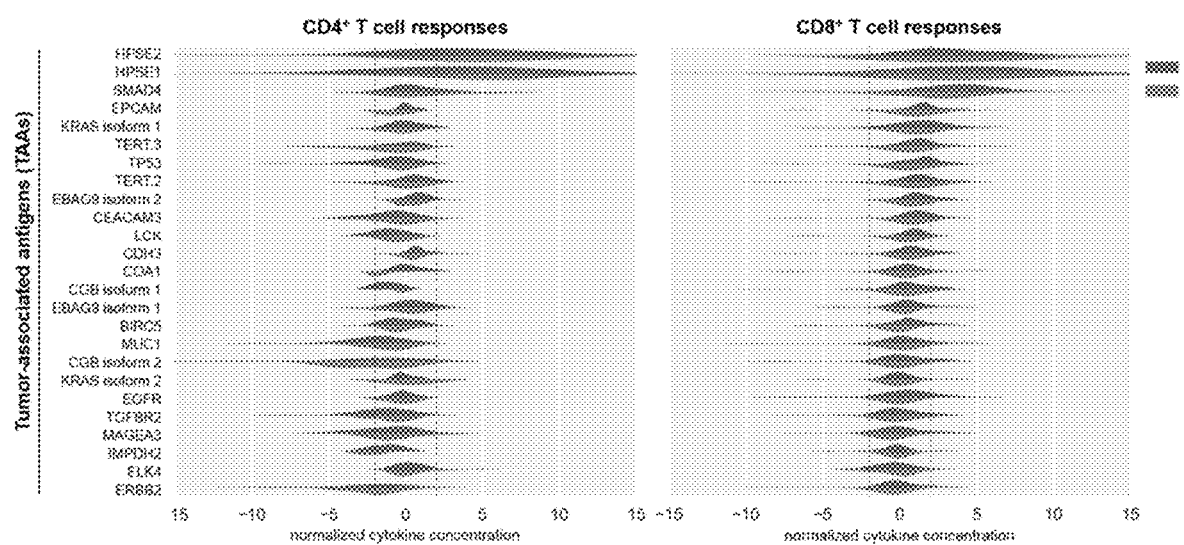
FIG. 14 is a graph showing response profiles to 25 CRC-associated TAAs across CRC patients with all stages of disease using TNF-α and IFN-γ secretion as an indicator for a recall response to a putative antigen.

FIG. 14 shows response profiles to 25 CRC-associated TAAs across CRC patients. CD4+ and CD8+ T cells from CRC patients across all stages of disease were profiled for responses to 25 TAAs, using TNF-α and IFN-γ secretion as an indicator for a recall response to a putative antigen. Distributions of normalized cytokine concentrations released in response to each antigen are shown, each row represents one antigen. Dashed vertical lines indicate 2 MADs from median cytokine release in response to the NG negative control antigen. Positive values, indicated by a shift toward the right side of the plot, indicate stimulatory T cell recall responses. Negative values, indicated by a shift toward the left side of the plot, indicate inhibitory and/or suppressive T cell recall responses.

Figure 15A:
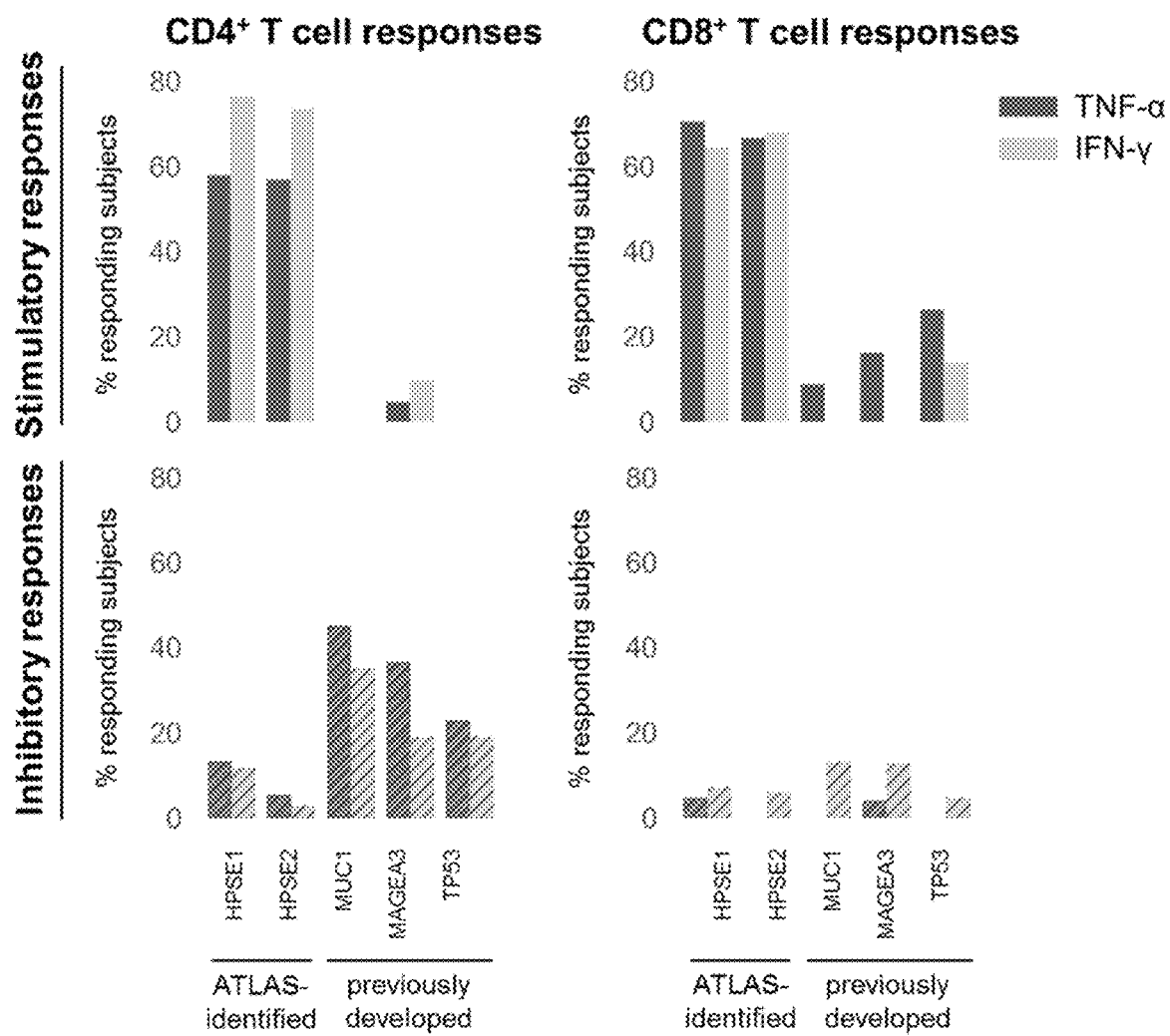

FIGS. 15A and 15B shows the high frequency of T cell responses to three TAAs not previously identified by algorithm. Response rates in individuals with CRC to three ATLAS-identified TAAs in comparison to three TAAs that are or were in clinical development as a therapeutic vaccine. FIG. 15A shows response rate of CD4+ and CD8+ T cells for HPSE1 and HPSE2, in comparison to MUC1, MAGEA3, and TP53. FIG. 15B shows response rate of CD8+ T cells for HPSE1, HPSE2 and SMAD4, in comparison to MUC1, MAGEA3, and TP53. Stimulatory (top panels) and inhibitory and/or suppressive (bottom panels) T cell recall responses are shown.

Figure 16:
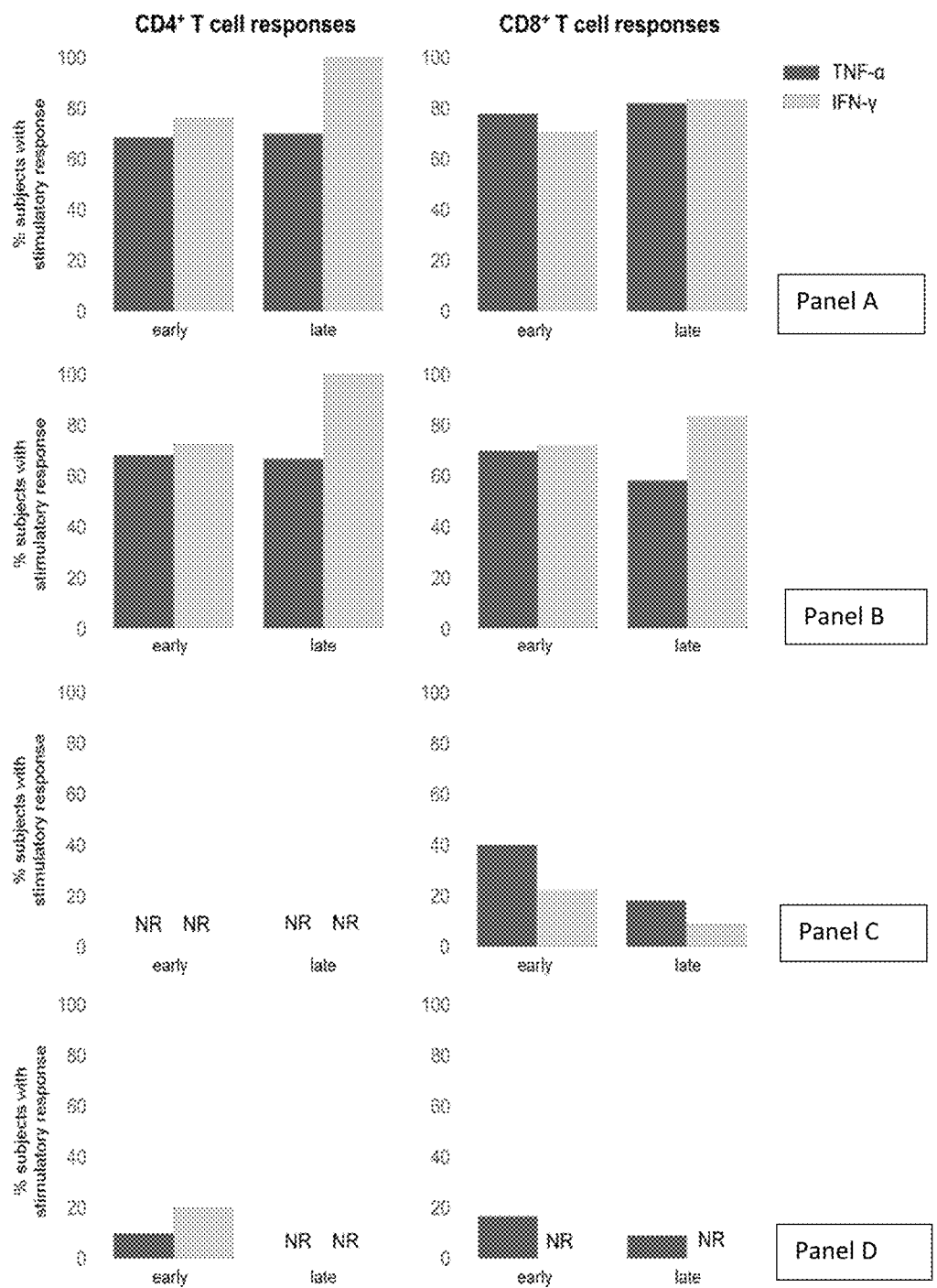
FIG. 16 is a graph showing stimulatory response rates to 4 selected TAAs for both CD4+ and CD8+ T cell subsets from CRC patients with early or late stage disease and TNF-α and IFN-γ cytokine release.

FIG. 16 shows T cell responses to selected TAAs in CRC patients with early or late stage disease (NR, no responders). Stimulatory response rates to four selected TAAs are shown for both CD4+ and CD8+ T cell subsets and TNF-α and IFN-γ cytokine release (Panel A=HPSE1; Panel B=HPSE2; Panel C=TP53; Panel D=MAGEA3). Patients were grouped by stage of disease with early stage representing stages I and II, i.e., locoregional disease, and late stage representing stages III and IV, i.e., with metastasis to lymph nodes or distant sites. There was no significant difference between response rates in early and late disease for either stimulatory responses (shown) or inhibitory and/or suppressive responses (not shown). Stage of cancer did not impact the T cell response signature.

Figure 17:
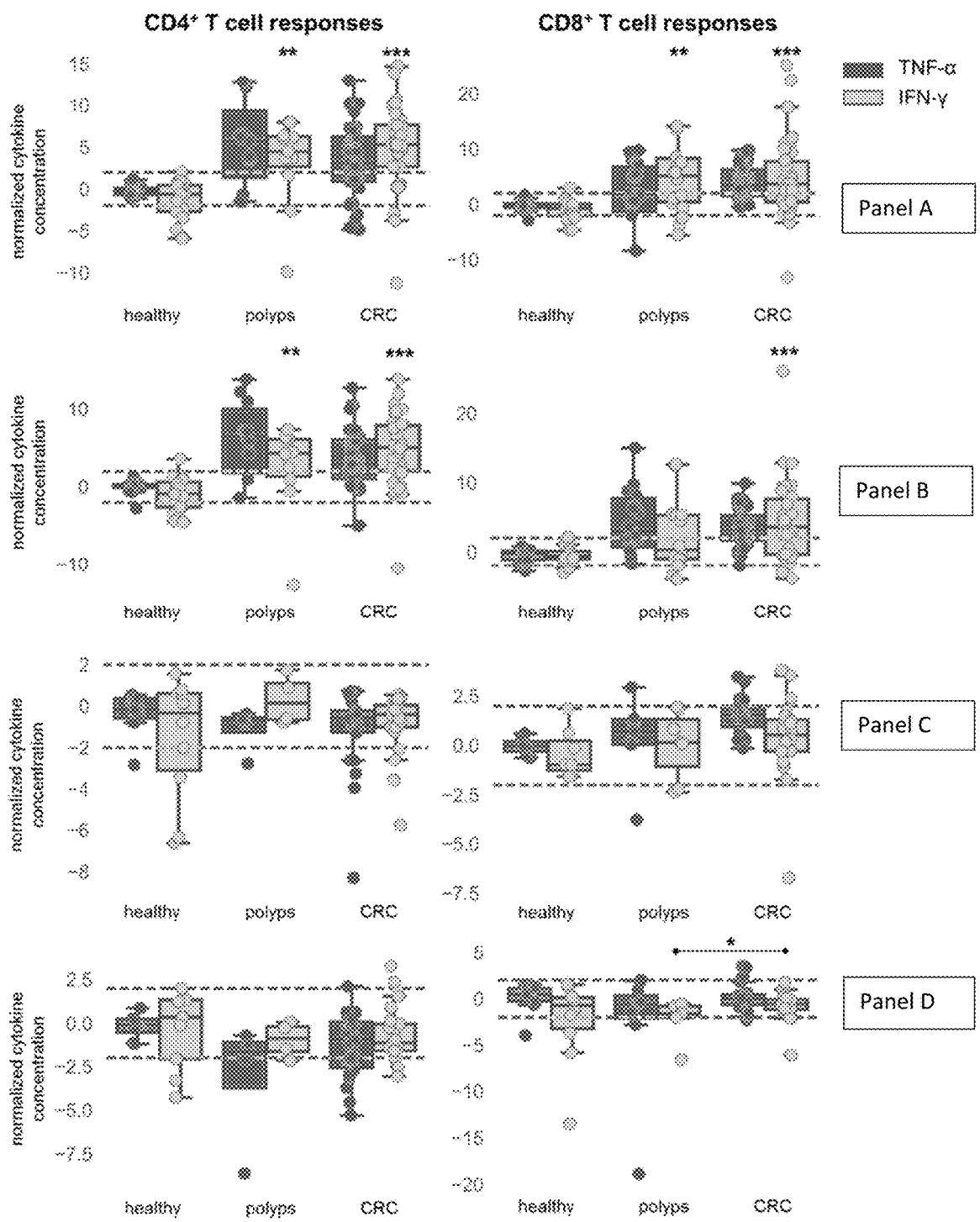
FIG. 17 is a graph showing normalized cytokine concentrations released in response to 4 selected TAAs in healthy individuals and donors with various disease states (polyps or CRC) for CD4+ and CD8+ T cell subsets and for TNF-α and IFN-γ release.

FIG. 17 shows T cell responses to selected TAAs in healthy individuals and donors with various disease states. Normalized cytokine concentrations released in response to the four selected TAAs in the three cohorts are shown for CD4+ and CD8+ T cell subsets and for TNF-α and IFN-γ release (Panel A=HPSE1; Panel B=HPSE2; Panel C=TP53; Panel D=MAGEA3). Each data point represents one individual. IFN-γ release in different cohorts was compared using a Wilcoxon rank sum test. Asterisks indicate statistical significance in comparison to cytokine release in healthy donors unless otherwise indicated. *p<0.05; p<0.01; *p<0.001. Significant differences based on TNF-α levels were detected across the same groups (not shown). Importantly, T cell responses to a subset of TAAs (HPSE1, HPSE2, SMAD4) in individuals with pre-malignant adenomatous polyps were similar to those in CRC patients and clearly distinguishable from the rare responses in healthy individuals. This pattern was not observed for responses to TAAs currently or previously investigated as therapeutic vaccines (MUC1, TP53, MAGEA3).

Example 8. Profiling of T Cell Responses to Tumor-Associated Antigens in Lung Cancer Patients Treated with Checkpoint Inhibitors Generation of an ATLAS Tumor Associated Antigen Library ATLAS was applied to characterize and profile T cell responses to Tumor Associated Antigens (TAAs) in a diverse sample of lung cancer patients undergoing ICI therapy. Seventy-six TAA genes (representing 74 unique genes, shown in Table 7) were cloned into the ATLAS expression vector and sequence verified. Each TAA was recombinantly expressed in *E. coli*, with expression verified using Western Blot analysis.

TABLE 7

ATLAS lung cancer TAA library

| Gene Name | Alias | Long Name | OMIM | GeneID |
|---|---|---|---|---|
| ACTN4 | ACTININ-4, FSGS, FSGS1 | actinin alpha 4 | 604638 | 81 |
| ACVR1 | ACTRIA, ACVRLK2, ALK2, FOP, SKR1, TSRI, ACVR1, ACTIVIN | activin A receptor type 1 | 102576 | 90 |
| ADH1C | ADH3 | alcohol dehydrogenase 1C (class I), gamma polypeptide | 103730 | 126 |
| ADORA2A | A2aR, ADORA2, RDC8, A2AR | adenosine A2a receptor | 102776 | 135 |
| AKAP-4 | AKAP 82, AKAP-4, AKAP82, CT99, FSC1, HI, PRKA4, hAKAP82, p8, AKAP4 | A-kinase anchoring protein 4 | 300185 | 8852 |
| ARHGEF16 | GEF16, NBR | Rho guanine nucleotide exchange factor 16 | | 27237 |
| BAGE | BAGE1; CT2.1 | B melanoma antigen 1 precursor | 605167 | 574 |
| BLNK | AGM4, BASH-S, LY57, SLP-65, SLP65, bca, BLNK | B-cell linker | 604515 | 29760 |
| BNC1 | BNC, BSN1, HsT19447 | basonuclin 1 | 601930 | 646 |
| BPIFA1 | LUNX, NASG, PLUNC, SPLUNC1, SPURT, bA49G10.5 | BPI fold containing family A member 1 | 607412 | 51297 |
| CACNB3 | CAB3, CACNLB3 | calcium voltage-gated channel auxiliary subunit beta 3 | 601958 | 784 |

TABLE 7-continued

ATLAS lung cancer TAA library

| Gene Name | Alias | Long Name | OMIM | GeneID |
|---|---|---|---|---|
| CASP3 | CPP32, CPP32B, SCA-1, CASPASE-3 | caspase 3 | 600636 | 836 |
| CAV1 | BSCL3, CGL3, LCCNS, MSTP085, PPH3, VIP21 | caveolin 1 | 601047 | 857 |
| CDH1 | Arc-1, BCDS1, CD324, CDHE, ECAD, LCAM, UVO | cadherin 1 | 192090 | 999 |
| COX8C | COX8-3 | cytochrome c oxidase subunit 8C | 616855 | 341947 |
| CPT1A | CPT1, CPT1-L, L-CPT1 | carnitine palmitoyltransferase 1A | 600528 | 1374 |
| CTAG1A | CT6.1, ESO1, LAGE-2, LAGE2A, NY-ESO-1 | cancer/testis antigen 1A | 300657 | 246100 |
| CTCFL | CT27; BORIS; CTCF-T; HMGB1L1; dJ579F20.2 | transcriptional repressor CTCFL | 607022 | 140690 |
| CXCL13 | ANGIE, ANGIE2, BCA-1, BCA1, BLC, BLR1L, SCYB13 | C—X—C motif chemokine ligand 13 | 605149 | 10563 |
| DGKH | DGKeta | diacylglycerol kinase eta | 604071 | 160851 |
| EEF2 | EEF-2, EF-2, EF2, SCA26 | eukaryotic translation elongation factor 2 | 130610 | 1938 |
| EGFR | ERBB; HER1; mENA; ERBB1; PIG61; NISBD2 | epidermal growth factor receptor | 131550 | 1956 |
| EIF5A | EIF-5A1, eIF5AI, EIF5A | eukaryotic translation initiation factor 5A | 600187 | 1984 |
| FN1 | CIG, ED-B, FINC, FN, FNZ, GFND, GFND2, LETS, MSF, Fibronectin | fibronectin 1 | 135600 | 2335 |
| GAGE1 | CT4.1; GAGE-1 | G antigen 1 | 300594 | 2543 |
| GAGE4 | CT4.4 | G antigen 121 | 300597 | 2576 |
| HLA-DRB1 | | major histocompatibility complex, class II, DR beta 1 | 142857 | 3123 |
| HLA-DRB5 | | major histocompatibility complex, class II, DR beta 5 | 604776 | 3127 |
| HPSE1 | | heparanase isoform 1 | 604724 | 10855 |
| HPSE2 | | heparanase isoform 2 | | |
| HSD17B3 | EDH17B3, SDR12C2 | hydroxysteroid 17-beta dehydrogenase 3 | 605573 | 3293 |
| IDE | INSULYSIN | insulin degrading enzyme | 146680 | 3416 |
| IDO1 | IDO, IDO-1, INDO | indoleamine 2,3-dioxygenase 1 | 147435 | 3620 |
| IGFBP5 | IBP5 | insulin like growth factor binding protein 5 | 146734 | 3488 |
| IGFBP7 | AGM, FSTL2, IBP-7, IGFBP-7, IGFBP-7v, IGFBPRP1, MAC25, PSF, | insulin like growth factor binding protein 7 | 602867 | 3490 |
| KCNK1 | DPK, HOHO, K2P1, K2p1.1, KCNO1, TWIK-1, TWIK1 | potassium two pore domain channel subfamily K member 1 | 601745 | 3775 |
| LAMP3 | CD208, DC LAMP, DC-LAMP, DCLAMP, LAMP, LAMP-3, TSC403 | lysosomal associated membrane protein 3 | 605883 | 27074 |
| MAGEA1 | CT1.1; MAGE1 | MAGE family member A1 | 300016 | 4100 |
| MAGEA3 | HIP8; HYPD; CT1.3; MAGE3; MAGEA6, MAGE-A3 (G-2544) | MAGE family member A3 | 300174 | 4102 |
| MAGEB2 | CT3.2, DAM6, MAGE-XP-2 | MAGE family member B2 | 300098 | 4113 |
| MAPK13 | MAPK 13, MAPK-13, PRKM13, SAPK4, p38delta | mitogen-activated protein kinase 13 | 602899 | 5603 |
| MARCO | SCARA2, SR-A6 | macrophage receptor with collagenous structure | 604870 | 8685 |
| ME1 | HUMNDME, MES | malic enzyme 1 | 154250 | 4199 |
| MIIP | IIP45, IGFBP-2 | migration and invasion inhibitory protein | 608772 | 60672 |
| MMP12 | HME, ME, MME, MMP-12 | matrix metallopeptidase 12 | 601046 | 4321 |
| MMP7 | MMP-7, MPSL1, PUMP-1 | matrix metallopeptidase 7 | 178990 | 4316 |
| MPZL1 | MPZL1b, PZR, PZR1b, PZRa, PZRb | myelin protein zero like 1 | 604376 | 9019 |

TABLE 7-continued

| ATLAS lung cancer TAA library | | | | |
|---|---|---|---|---|
| Gene Name | Alias | Long Name | OMIM | GeneID |
| MSR1 | CD204, SCARA1, SR-A, SR-AI, SR-AII, SR-AIII, SRA, phSR1, ph | macrophage scavenger receptor 1 | 153622 | 4481 |
| MUC1 | EMA; MCD; PEM; PUM; KL-6; MAM6; MCKD; PEMT; CD227; H23AG; MCKD1; MUC-1; ADMCKD; ADMCKD1; CA 15-3; MUC-1/X; MUC1/ZD; MUC-1/SEC | mucin-1 isoform 14 precursor | 158340 | 4582 |
| MYNN | OSZF, SBBIZ1, ZBTB31, ZNF902 | myoneurin | 606042 | 55892 |
| NAGK | GNK, HSA242910 | N-acetylglucosamine kinase | 606828 | 55577 |
| NAPSA | KAP, Kdap, NAP1, NAPA, SNAPA | napsin A aspartic peptidase | 605631 | 9476 |
| NFYC | CBF-C, CBFC, H1TF2A, HAP5, HSM, NF-YC | nuclear transcription factor Y subunit gamma | 605344 | 4802 |
| NKRF | ITBA4, NRF | NFKB repressing factor | 300440 | 55922 |
| PLAU | ATF, BDPLT5, QPD, UPA, URK, u-PA | plasminogen activator, urokinase | 191840 | 5328 |
| ROR1 | NTRKR1, dJ537F10.1 | receptor tyrosine kinase like orphan receptor 1 | 602336 | 4919 |
| RUNX1 | AML1, AML1-EVI-1, AMLCR1, CBF2alpha, CBFA2, EVI-1, PEBP2aB, | runt related transcription factor 1 | 151385 | 861 |
| SFTPA1 | COLEC4, PSAP, PSP-A, PSPA, SFTP1B, SP-A, SP-A1, SPA, SPA1, | surfactant protein A1 | 178630 | 653509 |
| SFTPA2 | COLEC5, PSAP, PSP-A, PSPA, SFTP1B, SP-2A, SP-A, SPA2, SPAII | surfactant protein A2 | 178642 | 729238 |
| SFTPB | PSP-B, SFTB3, SFTP3, SMDP1, SP-B | surfactant protein B | 178640 | 6439 |
| SFTPC | BRICD6, PSP-C, SFTP2, SMDP2, SP-C | surfactant protein C | 178620 | 6440 |
| SFTPD | COLEC7, PSP-D, SFTP4, SP-D | surfactant protein D | 178635 | 6441 |
| SLC2A5 | GLUT-5, GLUT5, SGT1 | solute carrier family 2 member 5 | 138230 | 6518 |
| SPAG9 | CT89, HLC-6, HLC4, HLC6, JIP-4, JIP4, JLP, PHET, PIG6 | sperm associated antigen 9 | 605430 | 9043 |
| SSX2 | SSX; HD21; CT5.2; CT5.2A; HOM-MEL-40 | protein SSX2 | 300192 | 6757 |
| SUGT1 | SGT1 | SGT1 homolog, MIS12 kinetochore complex assembly cochaperone | 604098 | 10910 |
| SULT1C2 | ST1C1, ST1C2, SULT1C1, humSULTC2 | sulfotransferase family 1C member 2 | 602385 | 6819 |
| TGFBR2 | AAT3, FAA3, LDS1B, LDS2, LDS2B, MFS2, RIIC, TAAD2, TGFR-2, | transforming growth factor beta receptor 2 | 190182 | 7048 |
| TMEM52B | | transmembrane protein 52B | | 120939 |
| TP53 | P53; BCC7; LFS1; TRP53 | cellular tumor antigen p53 isoform a | 191170 | 7157 |
| VEGF-A | VPF; VEGF; MVCD1 | vascular endothelial growth factor A | 192240 | 7422 |
| XPO7 | EXP7, RANBP16 | exportin 7 | 606140 | 23039 |
| YES1 | HsT441, P61-YES, Yes, c-yes | YES proto-oncogene 1, Src family tyrosine kinase | 164880 | 7525 |
| CCDC80 | DRO1, SSG1, URB, okuribin | coiled-coil domain containing 80 | 608298 | 151887 |

OMIM = Online Mendelian Inheritance in Man database
GeneID = NCBI database

ATLAS Library Screening

Blood samples were collected from 13 consenting patients undergoing ICI therapy. Frozen peripheral blood mononuclear cells (PBMC) were purchased from Bioreclamation (New York). After thaw, CD4+ and CD8+ T cells were sorted using antibody-conjugated magnetic beads and non-specifically expanded with anti-CD3 and anti-CD28 stimulation. CD14+ monocytes were also sorted using antibody-conjugated magnetic beads and differentiated in vitro into dendritic cells (MDDCs).

CD4+ and CD8+ T cells were screened against the 76 library clones, as well as against 10 negative control clones expressing Neon Green (NG). Library clones were screened using 1,000-5,000 MDDCs and 80,000 T cells, at an *E. coli*:MDDC ratio of 333:1. After 24 h incubation, assay supernatants were harvested and stored at −80° C. Supernatant cytokines levels were analyzed using a Meso Scale Discovery custom plate.

Data Analysis

Clones that induced median cytokine responses that exceeded 2 median absolute deviations (MADs) of the median responses to the negative control Neon Green clones (N=10) (indicated by a horizontal dotted line in FIG. 18 and FIG. 19) were considered antigens. Clones that reduced median cytokine responses to two MADs below the median negative control responses were considered inhibitory and/or suppressive antigens.

Figure 18:
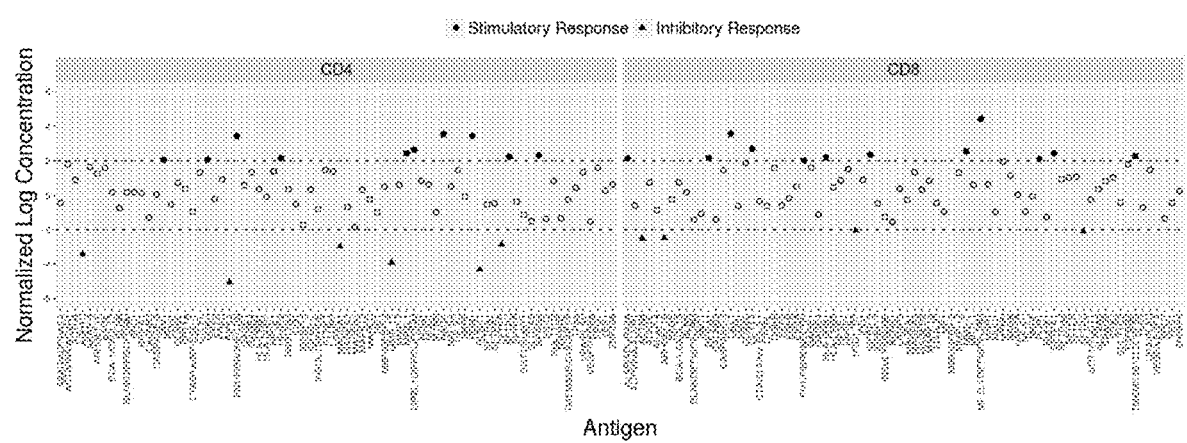
FIG. 18 is a graph showing an exemplary empirical determination of T cell responses to profiled TAAs. Exemplary data is shown for a single lung cancer patient. T cell responses are reported as natural log concentrations extrapolated from the MSD standard curve and normalized to the patient's response to a negative control protein.

FIG. 18 shows an exemplary empirical determination of T cell responses to profiled TAAs. Exemplary data is shown for a single lung cancer patient. T cell responses were reported as natural log concentrations back-calculated from the MSD standard curve and normalized to the patient's response to a negative control protein. A stimulatory response was defined as a TAA with a median concentration greater than two MADs above the median of the negative control replicates. This threshold is shown as the upper dashed horizontal line, and stimulatory responses are shown as filled circles. An inhibitory and/or suppressive response was defined as a TAA with a median concentration greater than two MADs of the negative control replicates below the median of the negative control replicates. This threshold is shown as the lower dashed horizontal line, and inhibitory and/or suppressive responses are shown as filled triangles.

Figure 19:
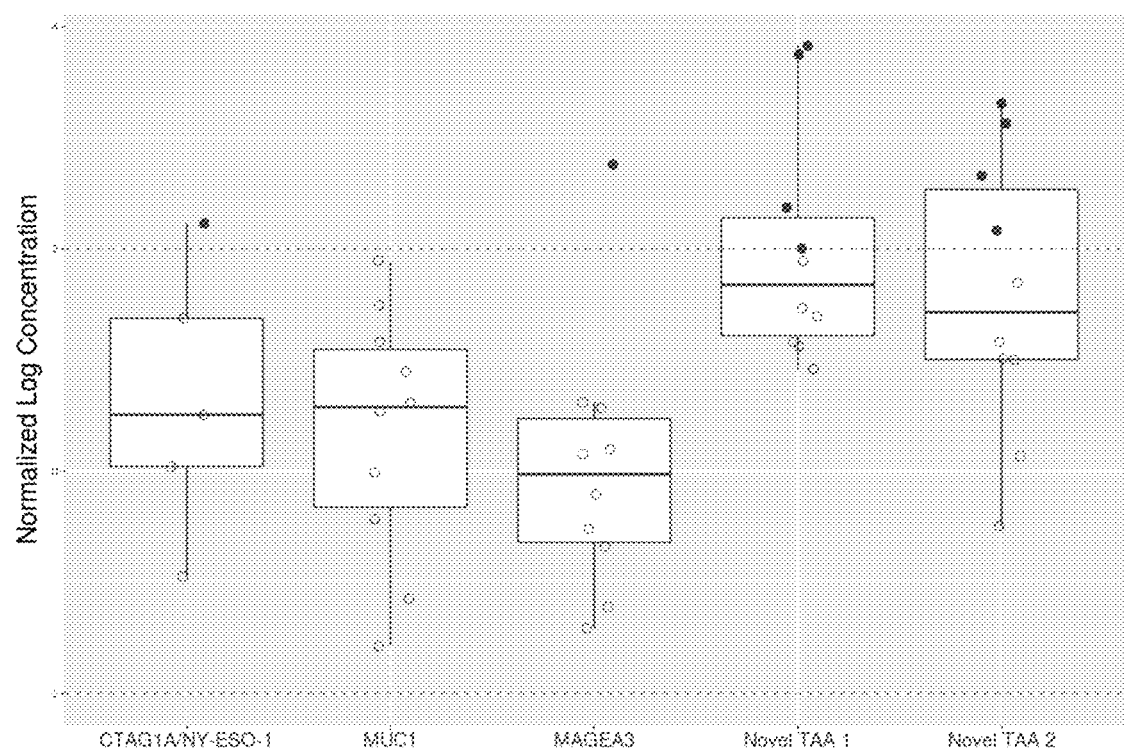
FIG. 19 is a graph showing shows frequent CD4+ T cell responses to two novel TAAs compared to previously described TAAs (NY-ESO-1, MUC1, and MAGEA3). Each point represents a patient's response to that TAA, normalized to the patient's response to a negative control protein. Stimulatory responses are colored black.

FIG. 19 shows frequent CD4+ T cell responses to novel TAAs compared to previously described TAAs. Across patients, IFN-γ CD4+ T cell responses to two novel TAAs (Novel TAA1=HPSE1; Novel TAA2=HPSE2) appeared to be stronger than responses to NY-ESO-1, MUC1, and MAGEA3, three TAAs that have been utilized in cancer vaccines in clinical trials for treatment of lung cancer patients. Each point represents a patient's response to that TAA, normalized to the patient's response to an irrelevant negative control protein. Stimulatory responses, those that fall above the 2×MAD cutoff indicated by the upper horizontal dotted line, are colored black. Both the median normalized concentration and the proportion of stimulatory responses to these two TAAs were higher than those of the three other TAAs. CD8+ responses to these five TAAs were more similar across patients (not shown).

Figure 20:
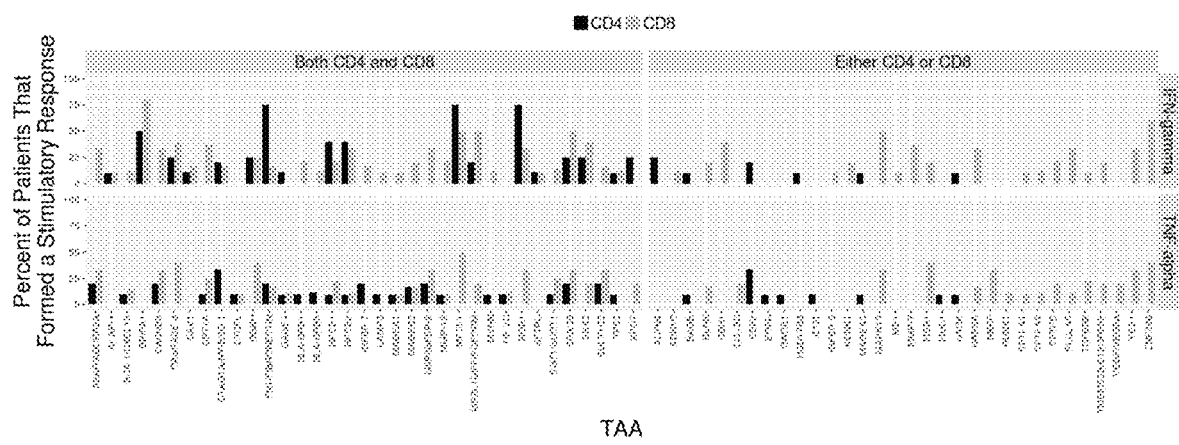
FIG. 20 is a graph showing CD4+ and CD8+ T cell responses to a broad range of TAAs from lung cancer patients.

FIG. 20 shows that lung cancer patients develop CD4+ and CD8+ T cell responses to a broad range of TAAs. Across lung cancer patients, stimulatory CD4+ and/or CD8+ T cell responses were observed in at least one individual to a clear majority of the 76 profiled TAAs. The percent of patients that developed a stimulatory T cell response to each TAA is shown separately for CD4+ (grey bars) and CD8+ (black bars) T cells. IFN-γ responses are displayed in the top two panels, and TNF-α responses are displayed in the bottom two panels. Antigens to which patients developed both a CD4+ and a CD8+ T cell response (left panels) were differentiated from antigens to which patients developed either a CD4+ or a CD8+ T cell response (right panels).

Figure 21:
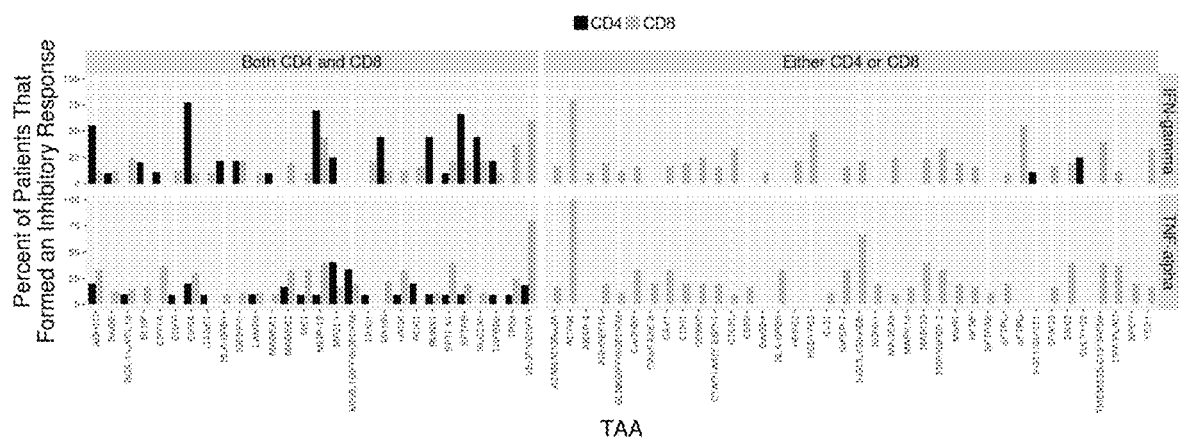
FIG. 21 is a graph showing inhibitory and/or suppressive T cell responses detected in most profiled TAAs across lung cancer patients.

FIG. 21 shows that inhibitory and/or suppressive T cell responses were detected in most profiled TAAs. Inhibitory and/or suppressive T cell responses to TAAs were observed frequently across the profiled lung cancer patients. For each profiled TAA, the percent of patients that developed an inhibitory and/or suppressive T cell response, defined as a response that is two MADs lower than the response to the negative control protein, are shown for CD4+(white bars) and CD8+ (grey bars) T cells. IFN-γ responses are displayed in the top two panels, and TNF-α responses are displayed in the bottom two panels. Antigens to which patients developed both a CD4+ and a CD8+ T cell response (left panels) were differentiated from antigens to which patients developed either a CD4+ or a CD8+ T cell response (right panels).

Example 9. Neoantigen Identification Using ATLAS$^T$ Across Multiple Tumor Types Generation of the ATLAS Neoantigen Library ATLAS was applied to characterize and profile pre-existing T cell responses to tumor specific mutations in a diverse set of cancer patients. Tumor biopsy and normal tissue samples were collected from 19 consenting patients. Whole exome and RNA sequencing of the tumor sample and whole exome sequencing of the matched normal sample identified mutations which are unique to the tumor and not present in the germline of the patient. Each somatic protein altering mutation was expressed as individual clones in the ATLAS expression vector and sequence verified. Each clone was recombinantly expressed in *E. coli*, with expression verified using Western Blot analysis.

ATLAS Library Screening

Blood samples were collected from 19 consenting patients and PBMCs isolated using standard procedures. Frozen peripheral blood mononuclear cells (PBMCs) were purchased from Conversant (Alabama) or obtained from collaborators. After thaw, CD4+ and CD8+ T cells were sorted using antibody-conjugated magnetic beads and non-specifically expanded with anti-CD3 and anti-CD28 stimulation. CD14+ monocytes were also sorted using antibody-conjugated magnetic beads and differentiated in vitro into myeloid derived dendritic cells (MDDCs).

CD4+ and CD8+ T cells were screened against the individuals' specific library clones, as well as against multiple negative control clones expressing Neon Green (NG). Library clones were screened using 1,000-5,000 MDDCs and 80,000 T cells, at an *E. coli*:MDDC ratio of 333:1. After 24 h incubation, assay supernatants were harvested and stored at −80° C. Supernatant cytokines levels were analyzed using a Meso Scale Discovery custom plate.

Data Analysis

Clones that induced median cytokine responses that exceeded 2 median absolute deviations (MADs) of the median responses to the negative control Neon Green clones (indicated by horizontal dotted line in FIG. 22) were considered stimulatory neoantigens. Clones that reduced median cytokine responses to 2 MADs below the median negative control responses were considered inhibitory and/or suppressive neoantigens.

Figure 22:
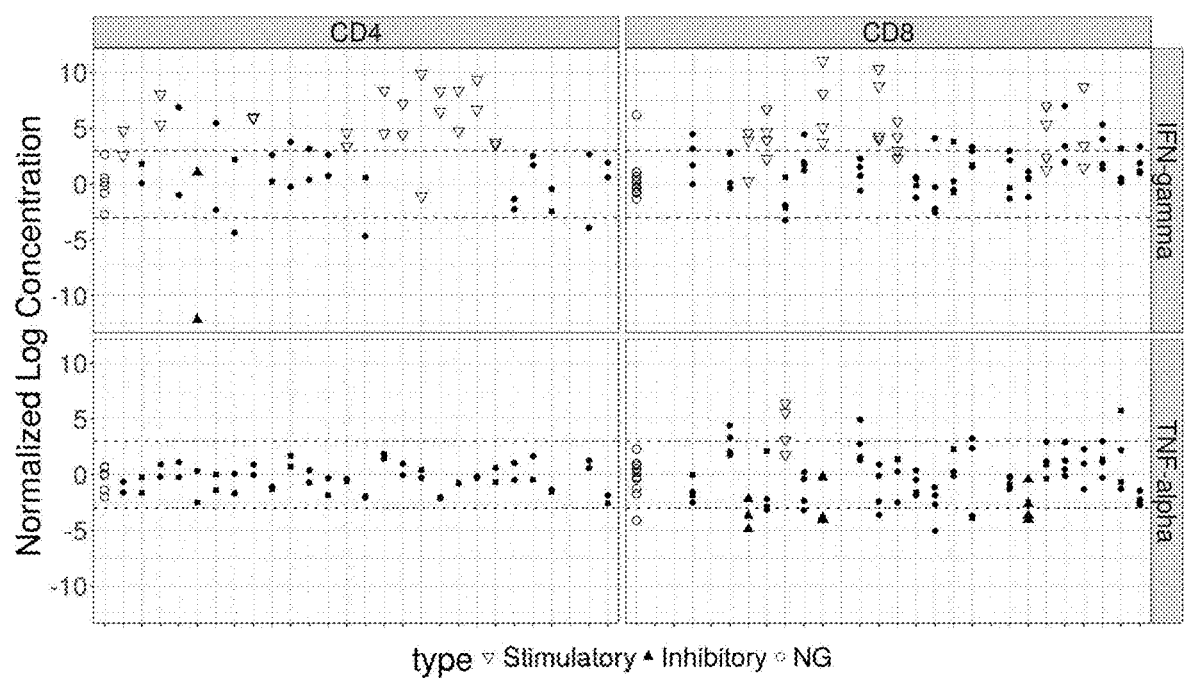
FIG. 22 is a graph showing a neoantigen screen with ATLAS identifying patient-specific CD4+ and CD8+ T cell responses. Each dot represents a technical replicate. Horizontal dotted lines indicate the cutoffs used to define stimulatory neoantigens and inhibitory and/or suppressive neoantigens at +3 and −3 Median Absolute Deviations (MADs), respectively.

FIG. 22 shows an exemplary neoantigen screen with ATLAS identifying patient-specific CD4+ and CD8+ T cell responses. For one pancreatic cancer subject, displayed are the CD4+ and CD8+ T cell responses observed in response to each candidate neoantigen. Each dot represents a technical replicate. Horizontal dotted lines indicate the cutoffs used to define stimulatory neoantigens and inhibitory and/or suppressive neoantigens at +3 and −3 Median Absolute Deviations (MADs), respectively.

Figure 23A:
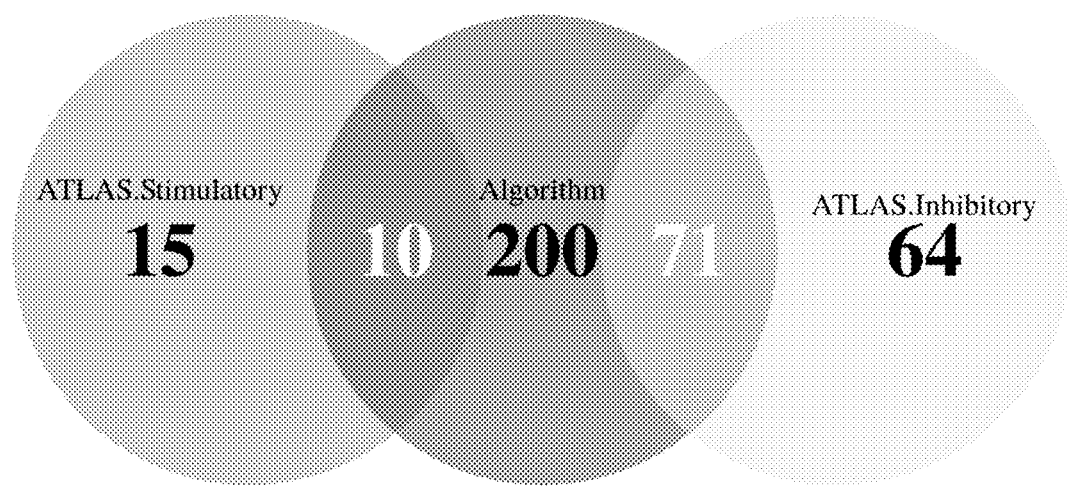
FIGS. 23A, 23B, 23C, and 23D show that algorithm prediction of MHC Class I binding does not accurately predict CD8+ T cell responses or types of response.
Figure 23B:
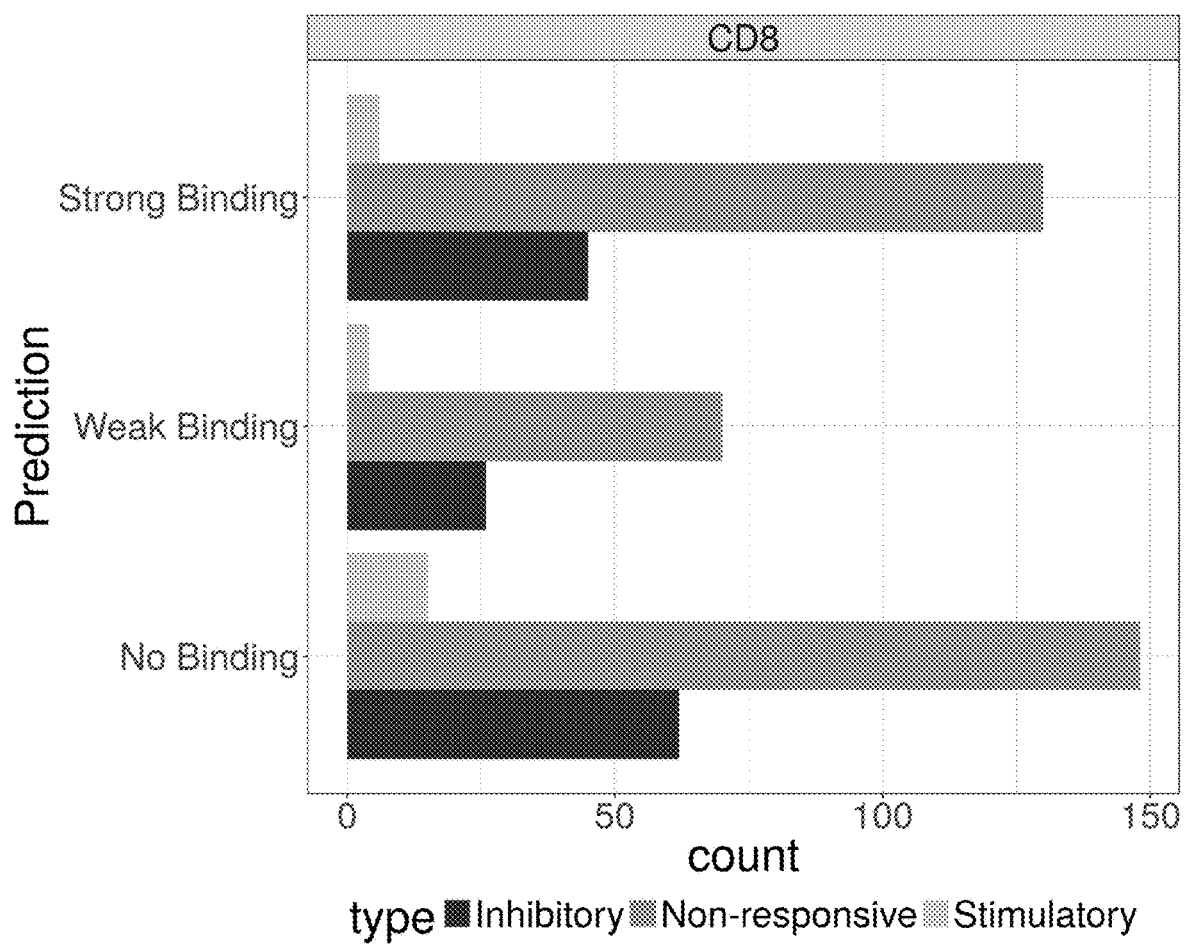
Figure 23C:
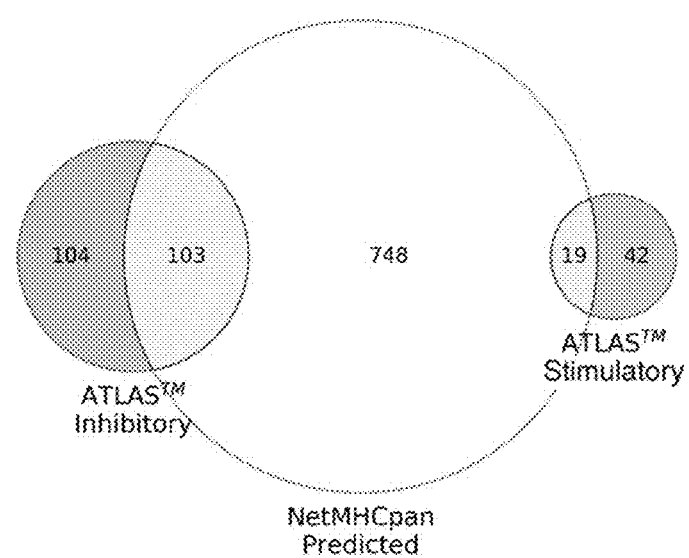
Figure 23D:
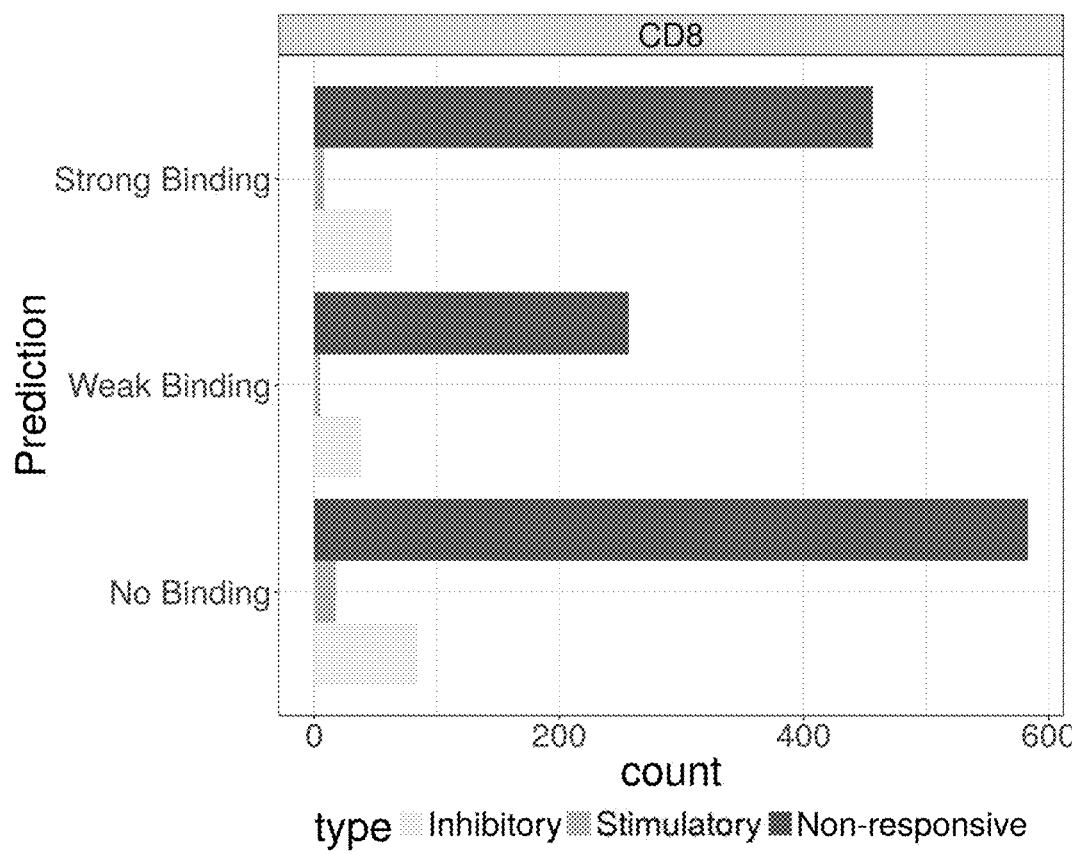

FIGS. 23A, 23B, 23C, and 23D show that an algorithm predicting MHC Class I binding did not accurately predict CD8+ T cell responses or type of response. The diagrams compare MHC class I algorithm-based binding predictions (NetMHCpan predictions with binding affinity cutoff of <500 nM) and T cell responses observed in ATLAS across 11 initial subjects and across all 19 subjects. FIGS. 23A and 23C show the total numbers and overlap of neoantigens predicted by algorithm and observed in ATLAS for the 11 initial subjects and for all 19 subjects, respectively. FIGS. 23B and 23D show the break-down of predictions by strong binding (<150 nM), weak binding (<500 nM), or non-binding (>=500 nM) for the 11 initial subjects and for all 19 subjects, respectively. There was no enrichment of either stimulatory or inhibitory and/or suppressive responses in CD8+ T cells across binding prediction groups.

Figure 24A:
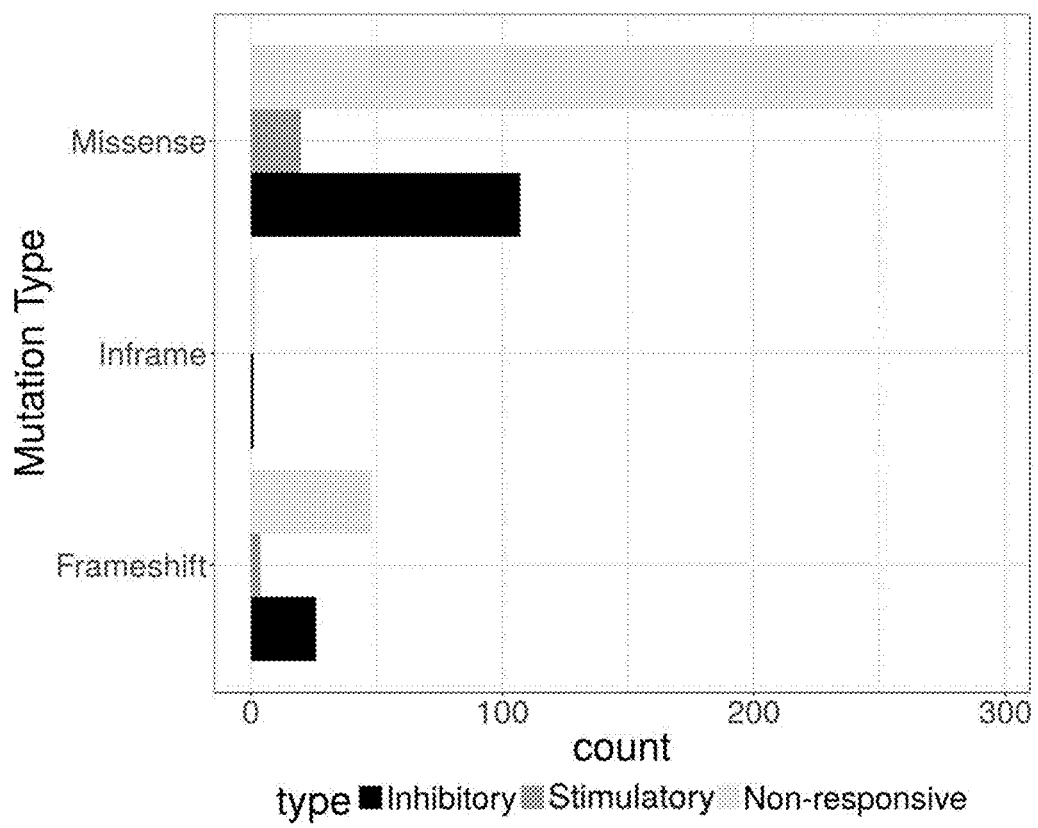
FIGS. 24A and 24B are graphs showing that CD8+ T cell responses identified by ATLAS to candidate neoantigens are not enriched for any mutation type.
Figure 24B:
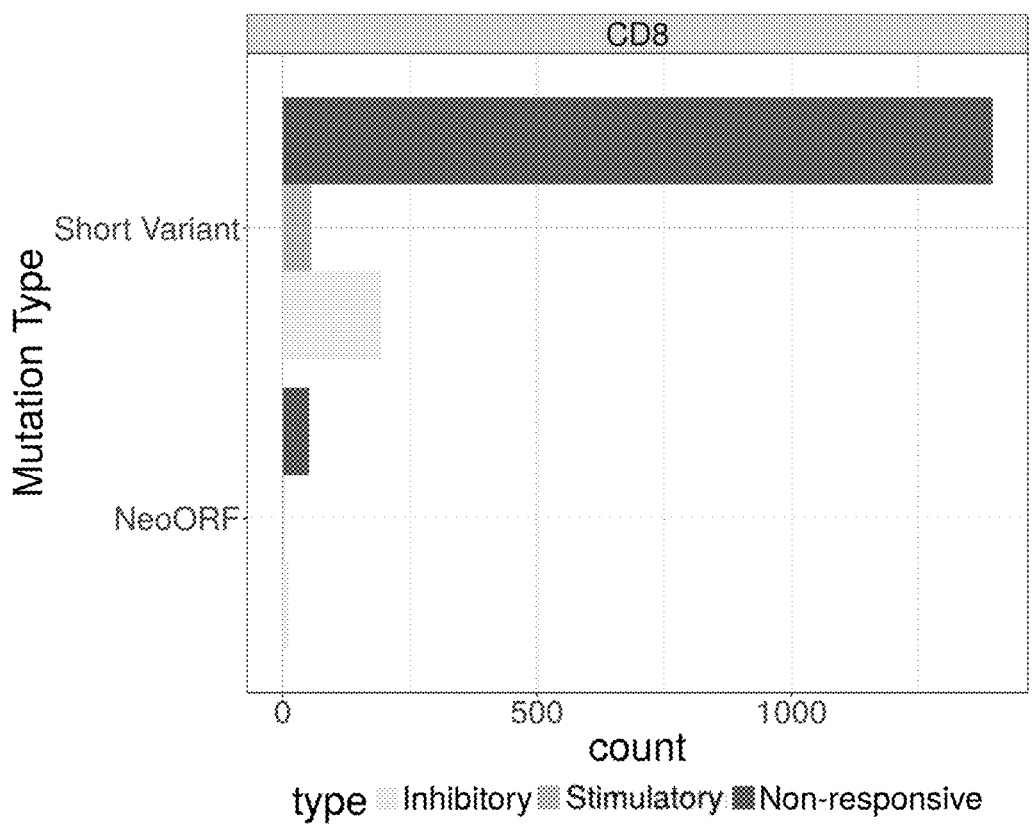

FIGS. 24A and 24B show that CD8+ T cell responses identified by ATLAS to candidate stimulatory neoantigens were not enriched for any mutation type. In FIG. 24A, mutation types for the 11 initial subjects were defined as missense, in-frame, or frameshift. In FIG. 24B, mutation types for all 19 subjects were defined as short variant (a combination of missense and in-frame mutations resulting in 1-2 amino acid changes relative to wild-type gene sequence) and neoORF (a combination of frameshift and loss-of-stop-codon mutations resulting in 3 or more amino acid changes relative to wild-type gene sequence). In this example, candidate inhibitory and/or suppressive neoantigens were somewhat more frequently associated with missense or short variant mutations.

Figure 25A:
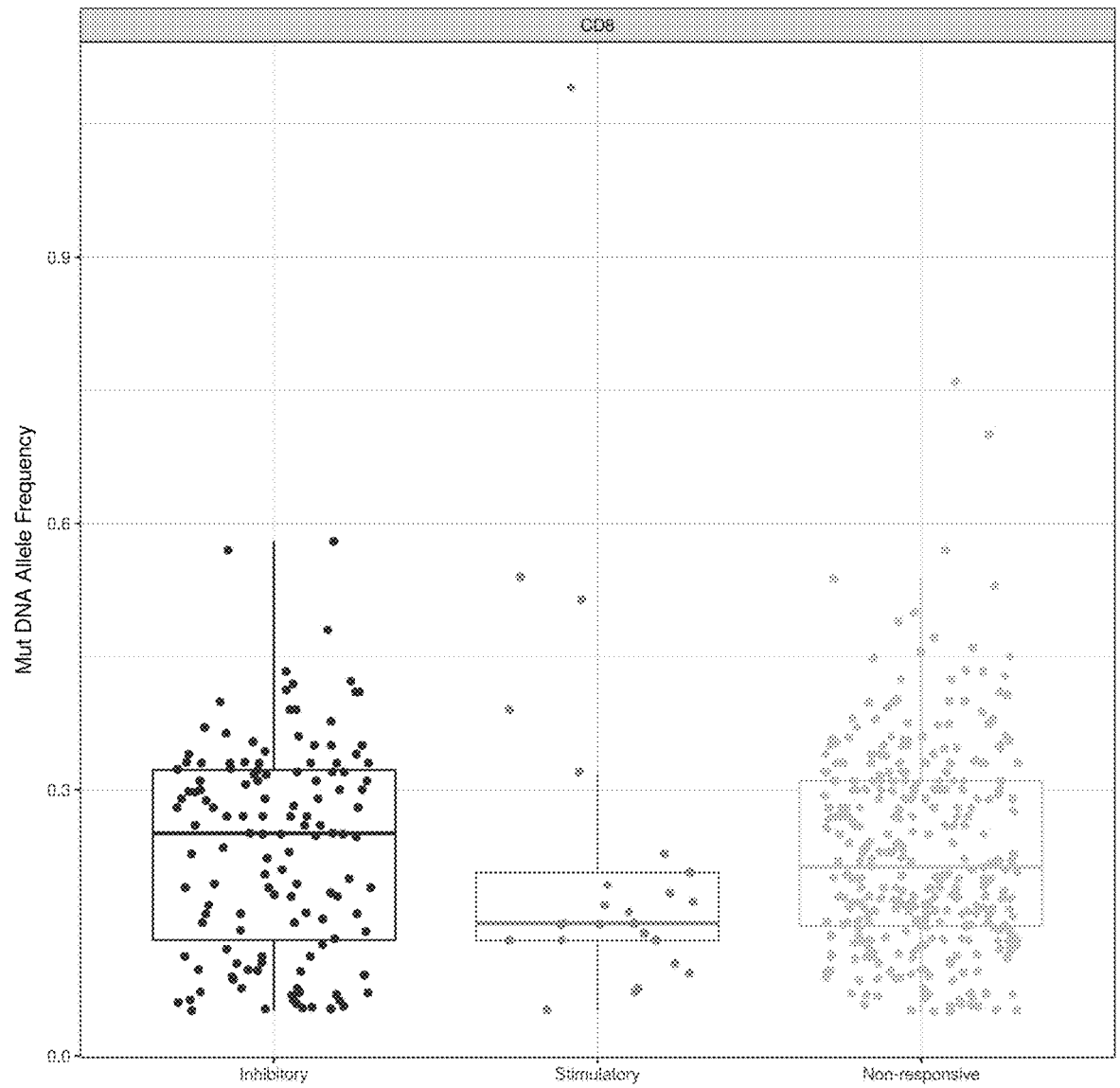
FIGS. 25A and 25B are graphs showing DNA mutant allele frequency is not associated with CD8+ T cell response frequency.
Figure 25B:
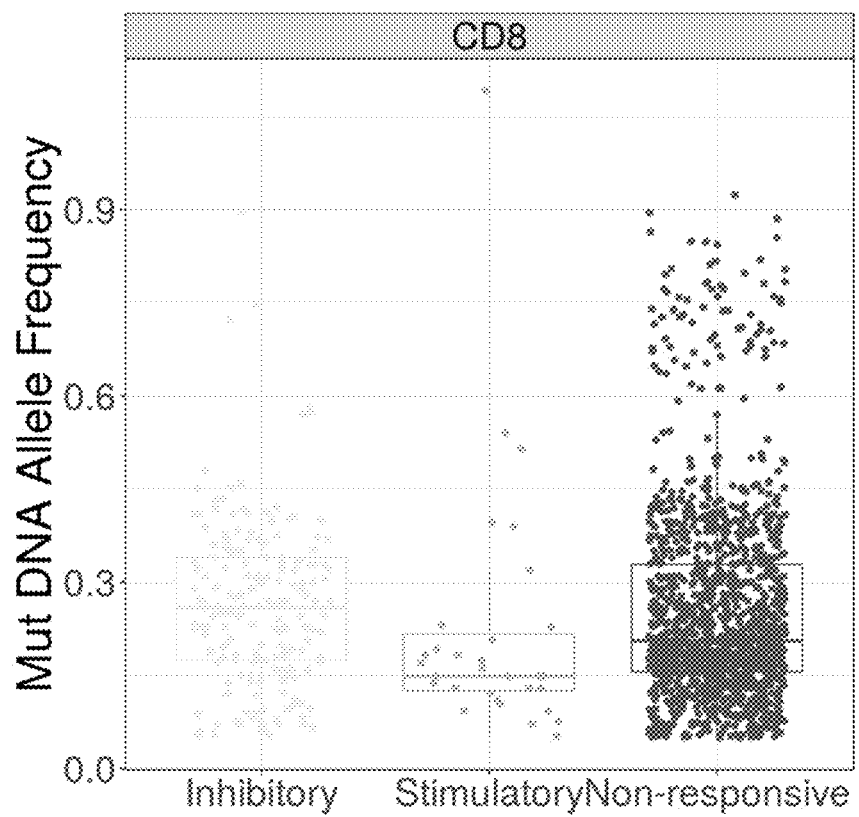

FIGS. 25A and 25B show that lower DNA mutant allele frequency has a moderate association with CD8+ T cell response frequency (P-value=0.037). Mutant DNA allele frequency was derived from whole exome sequencing and compared to response type observed. FIG. 25A shows results for the 11 initial subjects. FIG. 25B shows results for all 19 subjects.

Figure 26A:
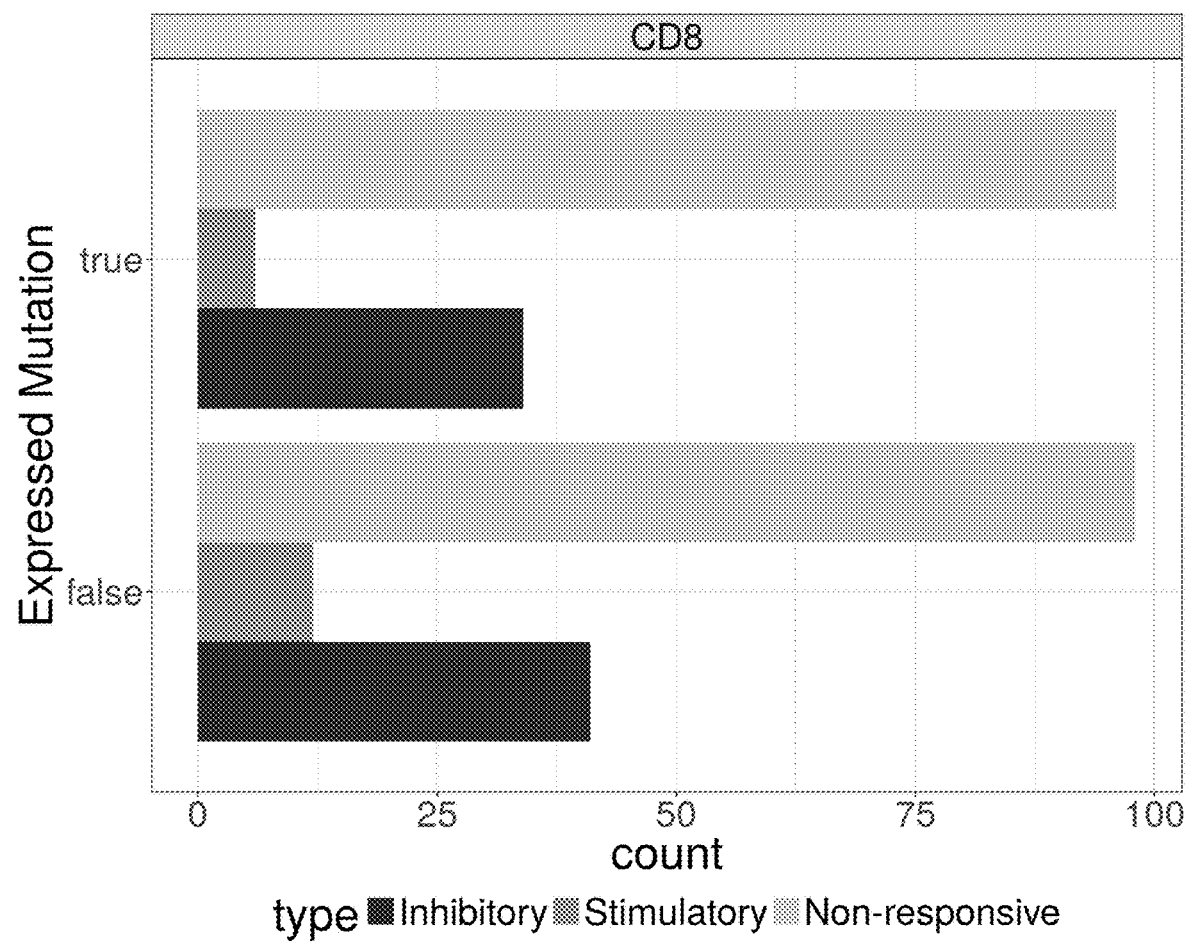
FIGS. 26A and 26B are graphs showing detection of a mutation in RNA does not predict whether the candidate neoantigen elicits a recall response in CD8+ T cells.
Figure 26B:
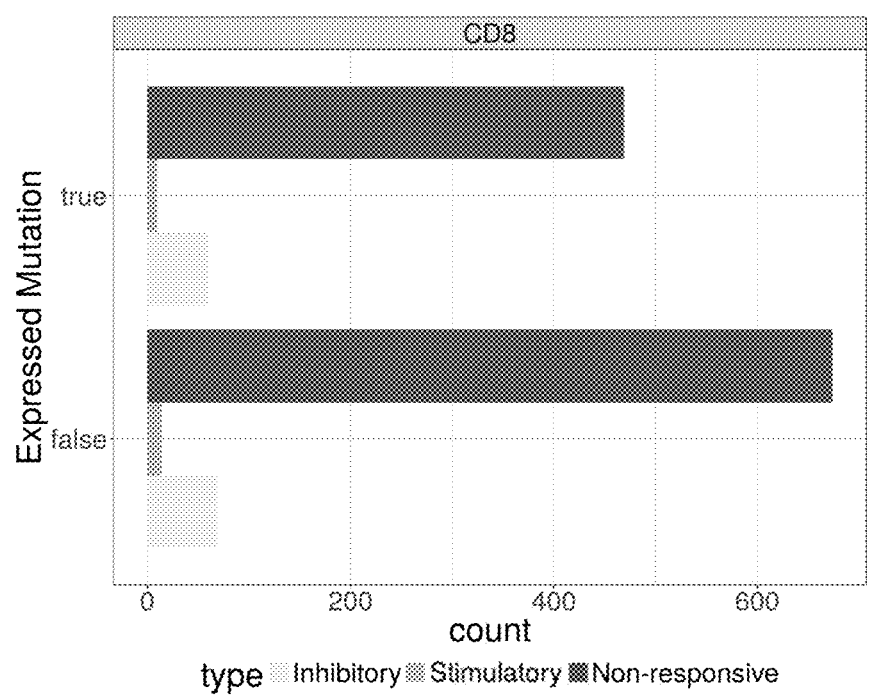

FIGS. 26A and 26B show that detection of a mutation in RNA did not predict whether the candidate stimulatory or inhibitory/suppressive antigen has a recall response in CD8+ T cells. RNA-seq was performed on the tumor material. Somatic mutations were identified via whole exome sequencing, and the RNA-seq data was interrogated for the presence or absence of mutations identified in DNA. FIG. 26A shows results for 8 of the 11 initial subjects. FIG. 26B shows results for all 19 subjects.

Figure 27A:
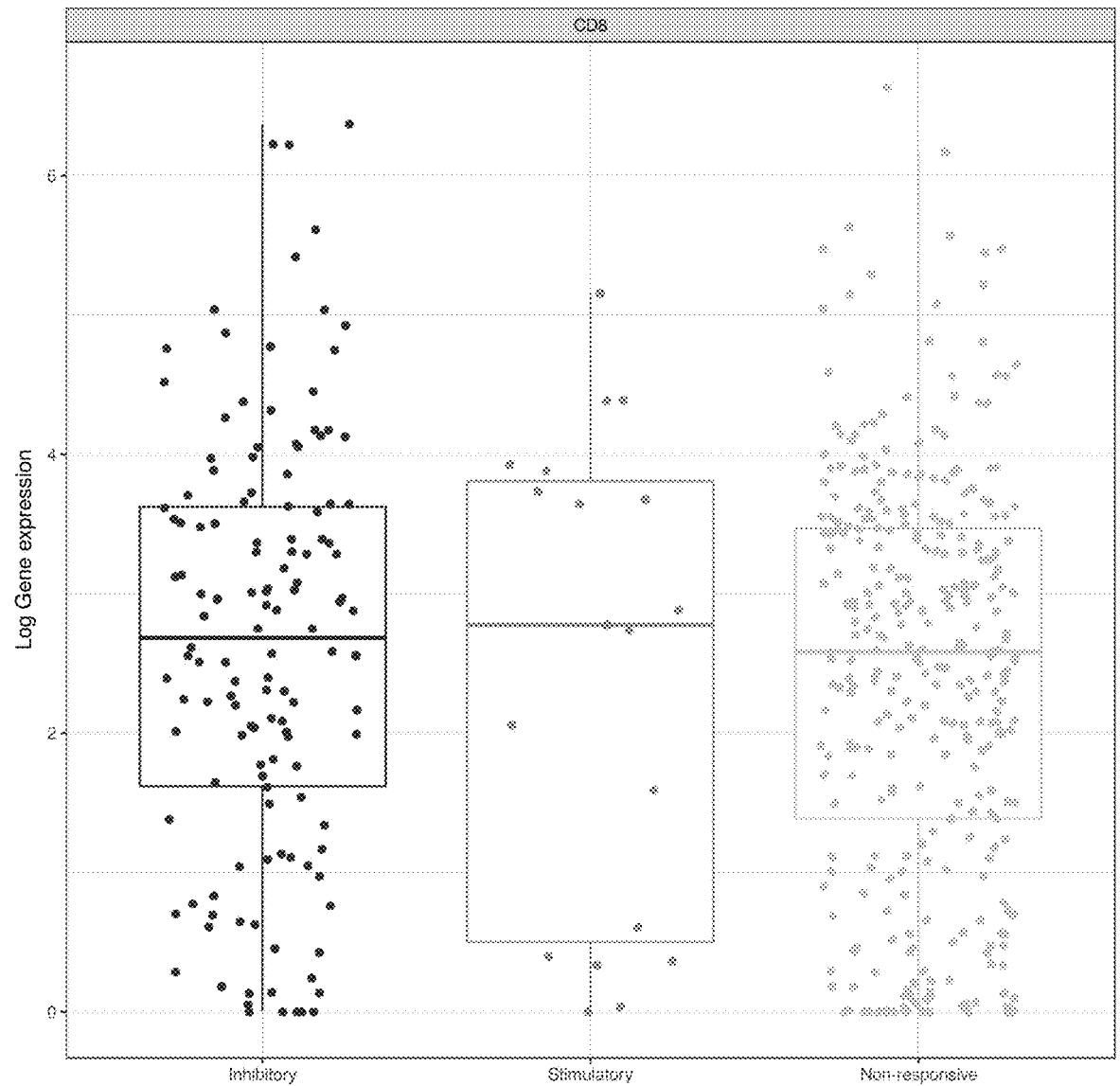
FIGS. 27A and 27B are graphs showing that CD8+ T cell responses identified by ATLAS to candidate neoantigens do not correlate with gene expression.
Figure 27B:
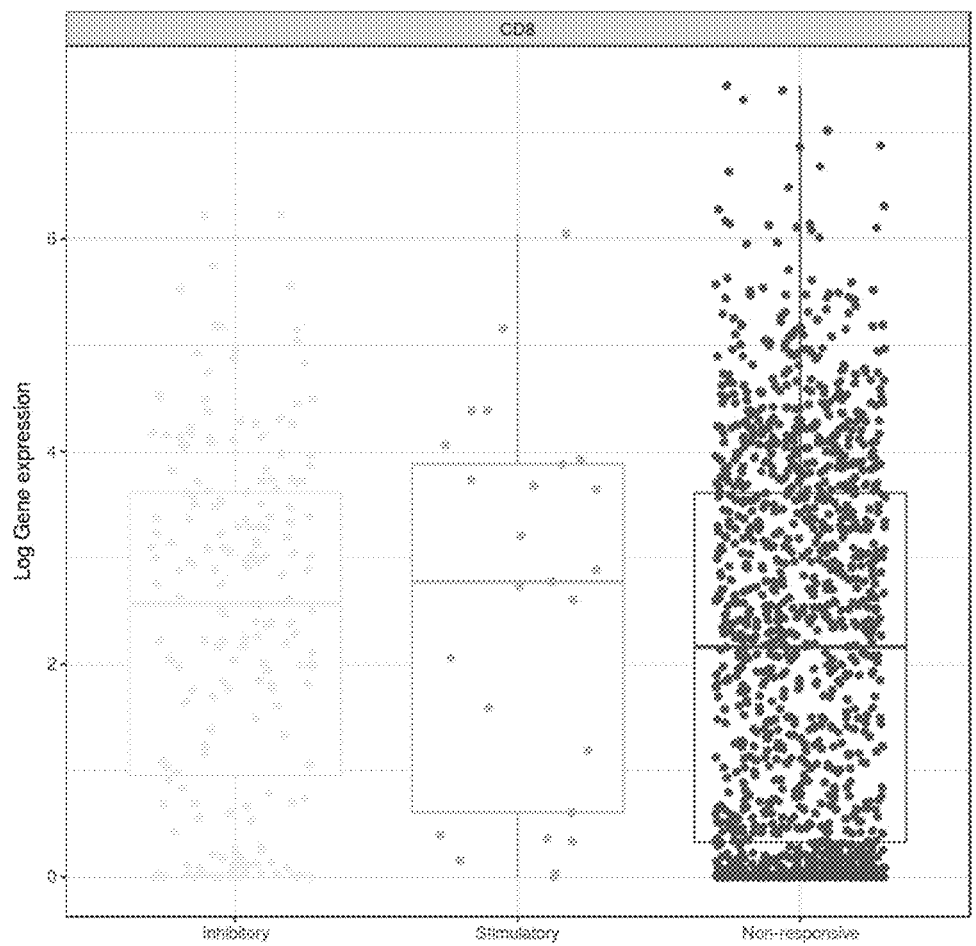

FIGS. 27A and 27B show that CD8+ T cell responses identified by ATLAS to candidate neoantigens did not correlate with gene expression. RNA-seq was performed on the tumor material; quantitative gene expression values were calculated for each gene harboring a candidate neoantigen and compared to normalized cytokine measurements. FIG. 27A shows results for 10 of the 11 initial subjects. FIG. 27B shows results for all 19 subjects.

Example 10. Different Cytokine Responses to Different Neoantigens Identified Using ATLAS in a Pancreatic Cancer Patient Generation of the ATLAS Neoantigen Library ATLAS was applied to screen the entire complement of mutations identified in the tumor of a consented pancreatic cancer patient. An ATLAS library was built that expressed 22 mutations unique to this patient. Each clone contained 113 amino acids with the mutation positioned near the center of the construct and sequence-verified. Each clone was recombinantly expressed in $E.$ $coli$ and protein expression was verified using Western Blot.

ATLAS Library Screening

Frozen peripheral blood mononuclear cells (PBMC) were purchased from Conversant Bio. After thaw, CD8+ T cells were sorted using antibody-conjugated magnetic beads and non-specifically expanded with anti-CD3 and anti-CD28 stimulation. CD14+ monocytes were also sorted using antibody-conjugated magnetic beads and differentiated in vitro into dendritic cells (MDDC).

CD8+ T cells were screened against the 22 library clones, as well as against a negative control clones expressing Neon Green (NG). Library clones were screened using 5,000 MDDC and 80,000 T cells, at an $E.$ $coli$:MDDC ratio of 333:1. After 19.5 h incubation, assay supernatants were harvested and stored at −80° C. Supernatant cytokines CM-CSF, IFNγ, IL-10, MIF, TNFα, and TRAIL were analyzed using a Meso Scale Discovery custom plate.

Data Analysis

Figure 28:
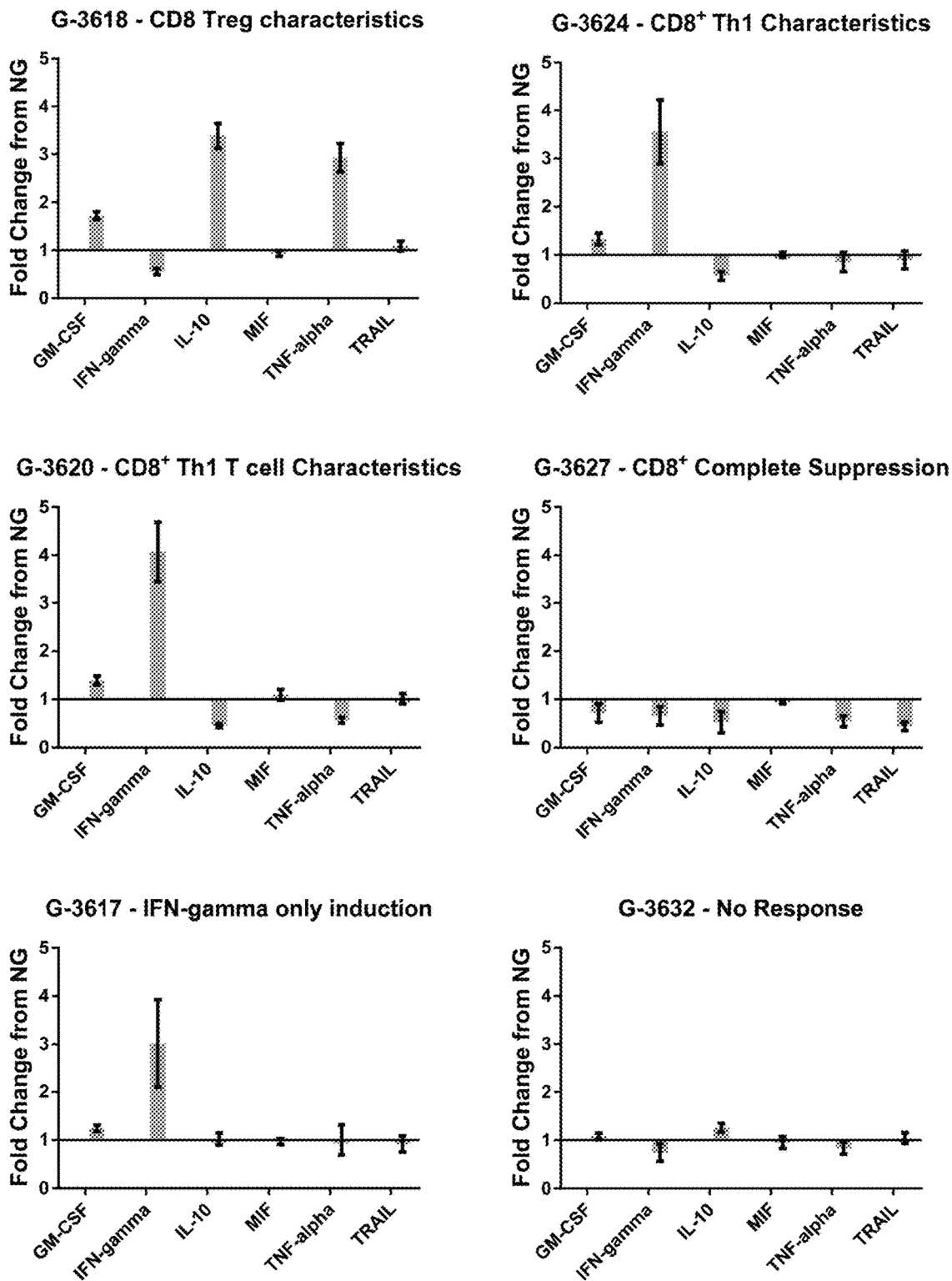
FIG. 28 is a graph illustrating the different cytokine response profiles elicited by 6 representative neoantigens in a screen of CD8+ T cells from a single patient.

FIG. 28 shows the different CM-CSF, IFNγ, IL-10, MIF, TNFα, and TRAIL response profiles elicited by six representative neoantigens in a screen of CD8+ T cells from the patient. Each panel corresponds to one neoantigen (denoted G-3618, G-3624, G-3620, G-3627, G-3617, and G-3632). The horizontal line in each panel indicates the median response to the negative controls. Bars above the horizontal line indicate stimulation of cytokine secretion. Bars below the horizontal line indicate inhibition and/or suppression of cytokine secretion. The panels illustrate the different cytokine responses elicited by each neoantigen.

Example 11. T Cell Responses to VEGF in a Cohort of Cancer Patients and Healthy Donors PBMC from eight cancer patients (seven lung cancer, one colorectal cancer) and 13 healthy donors were screened in duplicate against VEGF, a known TAA. CD8+ T cells were sorted and non-specifically expanded using anti-CD3 and anti-CD28-coated microbeads, and CD14+ monocytes were differentiated into dendritic cells (MDDC). Library clones were screened in duplicate using 5,000 MDDC and 80,000 T cells, at an $E.$ $coli$:MDDC ratio of 100:1; replicates of $E.$ $coli$ expressing neon green (NG) were included as negative controls. Assay supernatants were harvested at 24 hr and stored at −80° C. Supernatant cytokines were analyzed using Meso Scale Discovery V-PLEX Proinflammatory Panel 1 (human) Kit.

Data Analysis

Figure 29:
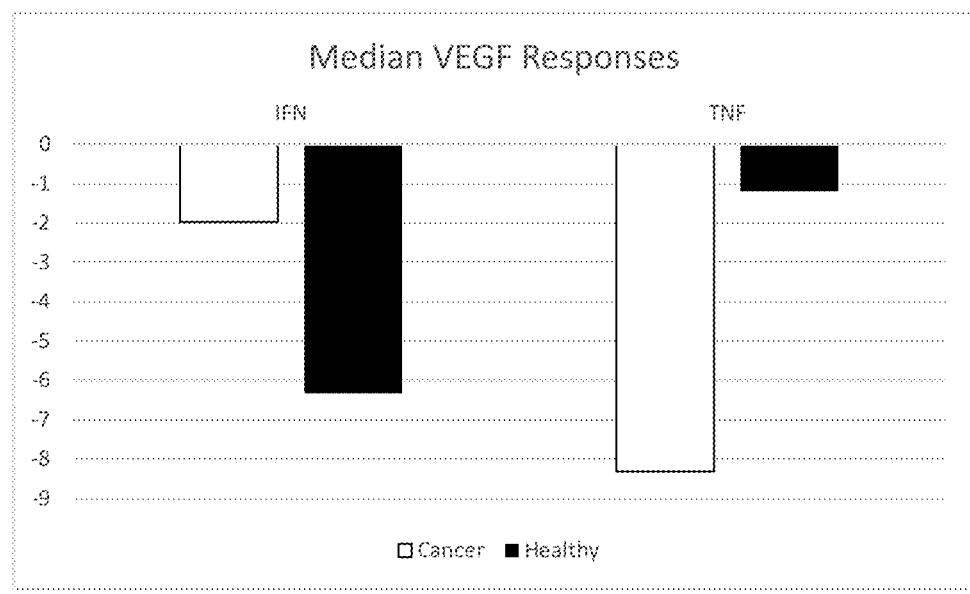
FIG. 29 is a graph showing CD8+ T cell data for healthy donors and cancer patients. When analyzed by IFNγ secretion, there was a large inhibitory response in the healthy donor cohort, that greatly exceeded the inhibitory responses in the cancer patient cohort. Conversely, there was a greater median inhibitory response in the cancer cohort when TNFα secretion was considered.

Clones that induced mean cytokine responses that exceeded 2 median average deviations (MAD) of the median responses to the negative control NG clones (N=10) were considered antigens. FIG. 29 shows CD8+ T cell data for healthy donors (black bars) and cancer patients (white bars). The median log cytokine response normalized to neon green are indicated for each subject cohort. When analyzed by IFNγ secretion, there was a large inhibitory response in the healthy donor cohort, that greatly exceeded the inhibitory responses in the cancer patient cohort. Conversely, there was a greater median inhibitory response in the cancer cohort when TNFα secretion was considered.

Example 12. In Vitro Immunization Using Combination of 3 TAAs

Protocol for In Vitro Immunization

PBMCs from healthy donors are enriched using standard protocols. Washed PBMCs are resuspended in supplemented RPMI-1640 medium. 100 μL cells ($2 \times 10^6$ cell/mL) are added into each well of a 96-well flat-bottom assay plate. Overlapping peptides corresponding to TAAs HPSE1, HPSE2, SMAD4, MUC1, MAGEA3, and TP53 were added to cultures at a final concentration of 50 μg/mL. Cultures are incubated for 5 days, the peptide-containing medium removed, then cultures provided with human IL-2 (10 U/mL) for 11 days, with IL-2-containing medium being replenished every 3 days. The incubation time of 5 days with peptide plus 11 days with IL-2 constitutes one cycle. Primary cultures are subsequently restimulated with the same peptides (50 ng/mL) on day 16 to begin the next cycle. Irradiated (4000 rad) autologous peripheral blood mononuclear cells ($5 \times 10^5$) are added in a volume of 50 μL in complete medium as APCs. An ELISPOT is performed on an aliquot of cells at the end of each cycle to observe de novo responses to the peptides.

```
LISTING OF SEQUENCES
Heparanase isoform 1, preproprotein, NP_001092010.1, NP_006656.2
                                                                 (SEQ ID NO: 6)
  1 mllrskpalp pplmllllgp lgplspgalp rpaqaqdvvd ldfftqeplh lvspsflsvt 61 idanlatdpr flillgspkl rtlarglspa ylrfggtktd flifdpkkes tfeersywqs 121 qvnqdickyg sippdveekl rlewpyqeql llrehyqkkf knstysrssv dvlytfancs 181 gldlifglna llrtadlqwn ssnaqllldy csskgynisw elgnepnsfl kkadifings 241 qlgedfiqlh kllrkstfkn aklygpdvgq prrktakmlk sflkaggevi dsvtwhhyyl 301 ngrtatkedf lnpdvldifi ssvqkvfqvv estrpgkkvw lgetssaygg gapllsdtfa 361 agfmwldklg lsarmgievv mrqvffgagn yhlvdenfdp lpdywlsllf kklvgtkvlm 421 asvqgskrrk lrvylhctnt dnprykegdl tlyainlhnv tkylrlpypf snkqvdkyll 481 rplgphglls ksvqlngltl kmvddqtlpp lmekplrpgs slglpafsys ffvirnakva 541 aci Heparanase isoform 2, preproprotein, NP_001159970.1
                                                                 (SEQ ID NO: 7)
  1 mllrskpalp pplmllllgp lgplspgalp rpaqaqdvvd ldfftqeplh lvspsflsvt 61 idanlatdpr flillgspkl rtlarglspa ylrfggtktd flifdpkkes tfeersywqs 121 qvnqdickyg sippdveekl rlewpyqeql llrehyqkkf knstysrssv dvlytfancs 181 gldlifglna llrtadlqwn ssnaqllldy csskgynisw elgnepnsfl kkadifings 241 qlgedfiqlh kllrkstfkn aklygpdvgq prrktakmlk sflkaggevi dsvtwhhyyl 301 ngrtatkedf lnpdvldifi ssvqkvfqdy wlsllfkklv gtkvlmasvq gskrrklrvy 361 lhctntdnpr ykegdltlya inlhnvtkyl rlpypfsnkq vdkyllrplg phgllsksvq 421 lngltlkmvd dqtlpplmek plrpgsslgl pafsysffvi rnakvaaci SMAD family member 4, mothers against decapentaplegic homolog 4,
NP_005350.1
                                                                 (SEQ ID NO: 8)
  1 mdnmsitntp tsndaclsiv hslmchrqgg esetfakrai eslvkklkek kdeldslita 61 ittngahpsk cvtiqrtldg rlqvagrkgf phviyarlwr wpdlhknelk hvkycqyafd 121 lkcdsvcvnp yhyervvspg idlsgltlqs napssmmvkd eyvhdfegqp slsteghsiq 181 tiqhppsnra stetystpal lapsesnats tanfpnipva stsqpasilg gshsegllqi 241 asgpqpgqqq ngftgqpaty hhnstttwtg srtapytpnl phhqnghlqh hppmpphpgh 301 ywpvhnelaf qppisnhpap eywcsiayfe mdvqvgetfk vpsscpivtv dgyvdpsggd 361 rfclgqlsnv hrteaierar lhigkgvqle ckgegdvwvr clsdhavfvq syyldreagr 421 apgdavhkiy psayikvfdl rqchrqmqqq aataqaaaaa qaaavagnip gpgsvggiap 481 aislsaaagi gvddlrrlci lrmsfvkgwg pdyprqsike tpcwieihlh ralqlldevl 541 htmpiadpqp ld
```

```
Cadherin 3, isoform 1 preproprotein, NP_001784.2
                                                                (SEQ ID NO: 9)
  1 mglprgplas lllqvcwlq caasepcrav freaevtlea ggaegepgqa lgkvfmgcpg
 61 qepalfstdn ddftvrnget vqerrslker nplkifpskr ilrrhkrdwv vapisvpeng
121 kgpfpqrlnq lksnkdrdtk ifysitgpga dsppegvfav eketgwllln kpldreeiak
181 yelfghavse ngasvedpmn isiivtdqnd hkpkftqdtf rgsvlegvlp gtsvmqvtat
241 deddaiytyn gvvaysihsq epkdphdlmf tihrstgtis vissgldrek vpeytltiqa
301 tdmdgdgstt tavavveild andnapmfdp qkyeahvpen avghevqrlt vtdldapnsp
361 awratylimg gddgdhftit thpesnqgil ttrkgldfea knqhtlyvev tneapfvlkl
421 ptstativvh vedvneapvf vppskvvevq egiptgepvc vytaedpdke nqkisyrilr
481 dpagwlamdp dsgqvtavgt ldredeqfvr nniyevmvla mdngsppttg tgtllltlid
541 vndhgpvpep rqiticnqsp vrqvlnitdk dlsphtspfq aqltddsdiy wtaevneegd
601 tvvlslkkfl kqdtydvhls lsdhgnkeql tviratvcdc hghvetcpgp wkggfilpvl
661 gavlallfll lvlllllvrkk rkikeplllp eddtrdnvfy ygeegggeed qdyditqlhr
721 glearpevvl rndvaptiip tpmyrprpan pdeignfiie nlkaantdpt appydtllvf
781 dyegsgsdaa slssltssas dqdqdydyln ewgsrfkkla dmygggedd
Cadherin 3, isoform 2 precursor, NP_001304124.1
                                                                (SEQ ID NO: 10)
  1 mglprgplas lllqvcwlq caasepcrav freaevtlea ggaeqepgqa lgkvfmgcpg
 61 qepalfstdn ddftvrnget vqerrslker nplkifpskr ilrrhkrdwv vapisvpeng
121 kgpfpqrinq lksnkdrdtk ifysitgpga dsppegvfav eketgwllln kpldreeiak
181 yelfghavse ngasvedpmn isiivtdqnd hkpkftqdtf rgsvlegvlp gtsvmqvtat
241 deddaiytyn gvvaysihsq epkdphdlmf tihrstgtis vissgldrek vpeytltiqa
301 tdmdgdgstt tavavveild andnapmfdp qkyeahvpen avghevqrlt vtdldapnsp
361 awratylimg gddgdhftit thpesnqgil ttrkgldfea knqhtlyvev tneapfvlkl
421 ptstativvh vedvneapvf vppskvvevq egiptgepvc vytaedpdke nqkisyrilr
481 dpagwlamdp dsgqvtavgt ldredeqfvr nniyevmvla mdngsppttg tgtllltlid
541 vndhgpvpep rqiticnqsp vrqvlnitdk dlsphtspfq aqltddsdiy wtaevneegd
601 tvvlslkkfl kqdtydvhls lsdhgnkeql tviratvcdc hghvetcpgp wkggfilpvl
661 gavlallfll lvlllllvrkk rkikeplllp eddtrdnvfy ygeegggeed qdyditqlhr
721 glearpevvl rndvaptiip tpmyrprpan pdeignfiie grgergsqrg ngglqlargr
781 trrs
Cadherin 3, isoform 3, NP_001304125.1
                                                                (SEQ ID NO: 11)
  1 mgcpgqepal fstdnddftv rngetvqerr slkernplki fpskrilrrh krdwvvapis
 61 vpengkgpfp grlnqlksnk drdtkifysi tgpgadsppe gvfaveketg wllInkpldr
121 eeiakyelfg haysengasv edpmnisiiv tdqndhkpkf tqdtfrgsvl egvlpgtsvm
181 qvtatdedda iytyngvvay sihsqepkdp hdlmftihrs tgtisvissg ldrekvpeyt
241 ltiqatdmdg dgstttavav veildandna pmfdpqkyea hvpenavghe vqrltvtdld
301 apnspawrat ylimggddgd hftitthpes nqgilttrkg ldfeaknqht lyvevtneap
361 fvlklptsta tivvhvedvn eapvfvppsk vvevqegipt gepvcvytae dpdkenqkis
421 yrilrdpagw lamdpdsgqv tavgtldred eqfvrnniye vmvlamdngs ppttgtgtll
481 ltlidvndhg pvpeprqiti cnqspvrqvl nitdkdlsph tspfqaqltd dsdiywtaev
```

```
541 neegdtvvls lkkflkqdty dvhlslsdhg nkeqltvira tvcdchghve tcpgpwkggf 601 ilpvlgavla llflllvlll lvrkkrkike plllpeddtr dnvfyygeeg ggeedqdydi 661 tqlhrglear pevvlrndva ptiiptpmyr prpanpdeig nfiienlkaa ntdptappyd 721 tllvfdyegs gsdaaslssl tssasdqdqd ydylnewgsr fkkladmygg gedd
```

Chorionic gonadotropin beta subunit 3, precursor, NP_000728.1

(SEQ ID NO: 12)
```
  1 memfqgllll lllsmggtwa skeplrprcr pinatlavek egcpvcitvn tticagycpt 61 mtrvlqgvlp alpqvvcnyr dvrfesirlp gcprgvnpvv syavalscqc alcrrsttdc 121 ggpkdhpltc ddprfqdsss skapppslps psrlpgpsdt pilpq
```

Chorionic gonadotropin beta subunit 5, precursor, NP_149032.1

(SEQ ID NO: 13)
```
  1 memfwgllll lllsmggtwa skeplrprcr pinatlavek egcpvcitvn tticagycpt 61 mtrvlqgvlp alpqvvcnyr dvrfesirlp gcprgvnpvv syavalscqc alcrrsttdc 121 ggpkdhpltc ddprfqdsss skapppslps psrlpgpsdt pilpq
```

Cytochrome c oxidase assembly factor 1 homolog, isoform a,
NP_001308126.1, NP_001308127.1, NP_001308128.1, NP_001308129.1,
NP_001337853.1, NP_001337854.1, NP_001337855.1, NP_001337856.1,
NP_060694.2

(SEQ ID NO: 14)
```
  1 mmwqkyagsr rsmplgaril fhgvfyaggf aivyyliqkf hsralyykla vewlwshpea 61 qealgpplni hylklidren fvdivdaklk ipvsgskseg llyvhssrgg pfqrwhldev 121 flelkdgqqi pvfklsgeng devkke
```

Cytochrome c oxidase assembly factor 1 homolog, isoform b,
NP_001308130.1

(SEQ ID NO: 15)
```
  1 mplgarilfh gvfyaggfai vyyliqkfhs ralyyklave qlwshpeawe algpplnihy 61 lklidrenfv divdaklkip vsgsksegll yvhssrggpf qrwhldevfl elkdgqqipv 121 fklsgengde vkke
```

Cytochrome c oxidase assembly factor 1 homolog, isoform c,
NP_001308131.1, NP_001308132.1, NP_001308133.1, NP_001308134.1

(SEQ ID NO: 16)
```
  1 mmwqkyagsr rsmplgaril fhgvfyaggf aivyyliqsk ypasrlrpdl llacscssir 61 gnt
```

Cytochrome c oxidase assembly factor 1 homolog, isoform d,
NP_001337857.1

(SEQ ID NO: 17)
```
  1 mqeaggwclw eqgsfstvcs mpgalplcit sfkfhsraly yklaveqlqs hpeaqealgp 61 plnihylkli drenfvdivd aklkipvsgs ksegllyvhs srggpfqrwh ldevflelkd 121 gqqipvfkls gengdevkke
```

Estrogen receptor binding site associated, antigen, 9,
NP_001265867.1, NP_004206.1, NP_936056.1, NP_001308129.1, (SEQ ID NO: 18)
```
  1 maitqfrlfk fctclatvfs flkrlicrsg rgrklsgdqi tlpttvdyss vpkqtdveew 61 tswdedapts vkieggngnv atqqnsleql epdyfkdmtp tirktqkivi kkreplnfgi 121 pdgstgfssr laatqdlpfi hqsselgdld twqentnawe eeedaawqae evlrqqklad 181 rekraaeqqr kkmekeaqrl mkkeqnkigv kls
```

ETS transcription factor, isoform a, NP_001964.2

(SEQ ID NO: 19)
```
  1 mdsaitlwqf llqllqkpqn khmicwtsnd gqfkllqaee varlwgirkn kpnmnydkls 61 ralryyyvkn iikkvngqkf vykfvsypei lnmdpmtvgr iegdceslnf sevsssskdv 121 enggkdkppq pgaktssrnd yihsglyssf tlnslnssnv klfkklikten paeklaekks 181 pqeptpsvik fvttpskkpp vepvaatisi gpsispssee tiqaletlvs pklpsleapt
```

-continued

```
241 sasnvmtafa ttppissipp lqepprtpsp plsshpdidt didsvasqpm elpenlslep 301 kdqdsvllek dkvnnssrsk kpkglelapt lvitssdpsp lgilspslpt asltpaffsq 361 tpiiltpspl lssihfwstl spvaplspar lqgantlfqf psvlnshgpf tlsgldgpst 421 pgpfspdlqk t
```

ETS transcription factor, isoform b, NP_068567.1
(SEQ ID NO: 20)

```
  1 mdsaitlwqf llqllqkpqn khmicwtsnd gqfkllqaee varlwgirkn kpnmnydkls 61 ralryyyvkn iikkvngqkf vykfvsypei lnmdpmtvgr iegdceslnf sevsssskdv 121 enggkdkppq pgaktssrnd yihsglyssf tlnslnssnv klfkliktеn paeklaekks 181 pqeptpsvik fvttpskkpp vepvaatisi gpsispssee tiqaletlvs pklpsleapt 241 sasnvmtafa ttppissipp lqepprtpsp plsshpdidt didsvasqpm elpenlslep 301 kdqdsvllek dkvnnssrsk kpkglelapt lvitssdpsp lgilspslpt asltpaffsq 361 vacslfmvsp llsficpfkq iqnlytqvcf lllrfvlerl cvtvm
```

Receptor tyrosine-protein kinase erbB-2, isoform a precursor,
NP_004439.2
(SEQ ID NO: 21)

```
   1 melaalcrwg lllallppga astqvctgtd mklrlpaspe thldmlrhly qgcqvvqgnl 61 eltylptnas lsflqdiqev qgyvliahnq vrqvplqrlr ivrgtqlfed nyalavldng 121 dplnnttpvt gaspgglrel qlrslteilk ggvliqrnpq lcyqdtilwk difhknnqla 181 ltlidtnrsr achpcspmck gsrcwgesse dcqsltrtvc aggcarckgp lptdccheqc 241 aagctgpkhs dclaclhfnh sgicelhcpa lvtyntdtfe smpnpegryt fgascvtacp 301 ynylstdvgs ctlvcplhnq evtaedgtqr cekcskpcar vcyglgmehl revravtsan 361 iqefagckki fgslaflpes fdgdpasnta plqpeqlqvf etleeitgyl yisawpdslp 421 dlsvfqnlqv irgrilhnga ysltlqglgi swlglrslre lgsglalihh nthlcfvhtv 481 pwdqlfrnph qallhtanrp edecvgegla chqlcarghc wgpgptqcvn csqflrgqec 541 veecrvlqgl preyvnarhc lpchpecqpq ngsvtcfgpe adqcvacahy kdppfcvarc 601 psgvkpdlsy mpiwkfpdee gacqpcpinc thscvdlddk gcpaeqrasp ltsiisavvg 661 illvvvlgvv fgilikrrqq kirkytmrrl lqetelvepl tpsgampnqa qmrilketel 721 rkvkvlgsga fgtvykgiwi pdgenvkipv aikvlrents pkankeilde ayvmagvgsp 781 yvsrllgicl tstvqlvtql mpygclldhv renrgrlgsq dllnwcmqia kgmsyledvr 841 lvhrdlaarn vlvkspnhvk itdfglarll didetеyhad ggkvpikwma lesilrrrft 901 hqsdvwsygv tvwelmtfga kpydgipare ipdllekger lpqppictid vymimvkcwm 961 idsecrprfr elvsefsrma rdpqrfvviq nedlgpaspl dstfyrslle dddmgdlvda 1021 eeylvpqqgf fcpdpapgag gmvhhrhrss strsgggdlt lglepseeea prsplapseg 1081 agsdvfdgdl gmgaakglqs lpthdpsplq rysedptvpl psetdgyvap ltcspqpeyv 1141 nqpdvrpqpp spregplpaa rpagatlerp ktlspgkngv vkdvfafgga venpeyltpq 1201 ggaapqphpp pafspafdnl yywdqdpper gappstfkgt ptaenpeylg ldvpv
```

Receptor tyrosine-protein kinase erbB-2, isoform b, NP_001005862.1
(SEQ ID NO: 22)

```
  1 mklrlpaspe thldmlrhly qgcqvvqgnl eltylptnas lsflqdiqev qgyvliahnq 61 vrqvplqrlr ivrgtqlfed nyalavldng dplnnttpvt gaspgglrel qlrslteilk 121 ggvliqrnpq lcyqdtilwk difhknnqla ltlidtnrsr achpcspmck gsrcwgesse 181 dcqsltrtvc aggcarckgp lptdccheqc aagctgpkhs dclaclhfnh sgicelhcpa 241 lvtyntdtfe smpnpegryt fgascvtacp ynylstdvgs ctlvcplhnq evtaedgtqr
```

-continued

```
 301 cekcskpcar vcyglgmehl revravtsan iqefagckki fgslaflpes fdgdpasnta
 361 plqpeqlqvf etleeitgyl yisawpdslp dlsvfqnlqv irgrilhnga ysltlqglgi
 421 swlglrslre lgsglalihh nthlcfvhtv pwdqlfrnph qallhtanrp edecvgegla
 481 chqlcarghc wgpgptqcvn csqflrgqec veecrvlqgl preyvnarhc lpchpecqpq
 541 ngsvtcfgpe adqcvacahy kdppfcvarc psgvkpdlsy mpiwkfpdee gacqpcpinc
 601 thscvdlddk gcpaeqrasp ltsiisavvg illvvvlgvv fgilikrrqq kirkytmrrl
 661 lqetelvepl tpsgampnqa qmrilketel rkvkvlgsga fgtvykgiwi pdgenvkipv
 721 aikvlrents pkankeilde ayvmagvgsp yvsrllgicl tstvqlvtql mpygclldhv
 781 renrgrlgsq dllnwcmqia kgmsyledvr lvhrdlaarn vlvkspnhvk itdfglarll
 841 didetyhad ggkvpikwma lesilrrrft hqsdvwsygv tvwelmtfga kpydgipare
 901 ipdllekger lpqppictid vymimvkcwm idsecrprfr elvsefsrma rdpqrfvviq
 961 nedlgpaspl dstfyrslle dddmgdlvda eeylvpqqgf fcpdpapgag gmvhhrhrss
1021 strsgggdlt lglepseeea prsplapseg agsdvfdgdl gmgaakglqs lpthdpsplq
1081 rysedptvpl psetdgyvap ltcspqpeyv nqpdvrpqpp spregplpaa rpagatlerp
1141 ktlspgkngv vkdvfafgga venpeyltpq ggaapqphpp pafspafdnl yywdqdpper
1201 gappstfkgt ptaenpeylg ldvpv
```

Receptor tyrosine-protein kinase erbB-2, isoform c, NP_001276865.1

(SEQ ID NO: 23)
```
   1 mprgswkpqv ctgtdmklrl paspethldm lrhlyqgcqv vqgnleltyl ptnaslsflq
  61 diqevggyvl iahnqvrqvp lqrlrivrgt qlfednyala vldngdplnn ttpvtgaspg
 121 glrelqlrsl teilkggvli qrnpqlcyqd tilwkdifhk nnqlaltlid tnrsrachpc
 181 spmckgsrcw gessedcqsl trtvcaggca rckgplptdc cheqcaagct gpkhsdclac
 241 lhfnhsgice lhcpalvtyn tdtfesmpnp egrytfgasc vtacpynyls tdvgsctlvc
 301 plhnqevtae dgtqrcekcs kpcarvcygl gmehlrevra vtsaniqefa gckkifgsla
 361 flpesfdgdp asntaplqpe qlqvfetlee itgylyisaw pdslpdlsvf qnlqvirgri
 421 lhngaysltl gglgiswlgl rslrelgsgl alihhnthlc fvhtvpwdql frnphqallh
 481 tanrpedecv geglachqlc arghcwgpgp tqcvncsqfl rgqecveecr vlqglpreyv
 541 narhclpchp ecqpqngsvt cfgpeadqcv acahykdppf cvarcpsgvk pdlsympiwk
 601 fpdeegacqp cpincthscv dlddkgcpae qraspltsii savvgillvv vlgvvfgili
 661 krrqqkirky tmrrllqete lvepltpsga mpnqaqmril ketelrkvkv lgsgafgtvy
 721 kgiwipdgen vkipvaikvl rentspkank eildeayvma gvgspyvsrl lgicltstvq
 781 lvtqlmpygc lldhvrenrg rlgsqdllnw cmqiakgmsy ledvrlvhrd laarnvlvks
 841 pnhvkitdfg larlldidet eyhadggkvp ikwmalesil rrrfthqsdv wsygvtvwel
 901 mtfgakpydg ipareipdll ekgerlpqpp ictidvymim vkcwmidsec rprfrelvse
 961 fsrmardpqr fvviqnedlg paspldstfy rslledddmg dlvdaeeylv pqqgffcpdp
1021 apgaggmvhh rhrssstrsg ggdltlglep seeeaprspl apsegagsdv fdgdlgmgaa
1081 kglqslpthd psplqrysed ptvplpsetd gyvapltcsp qpeyvnqpdv rpqppspreg
1141 plpaarpaga tlerpktlsp gkngvvkdvf afggavenpe yltpqggaap qphpppafsp
1201 afdnlyywdq dppergapps tfkgtptaen peylgldvpv
```

Receptor tyrosine-protein kinase erbB-2, isoform d precursor, NP_001276866.1

(SEQ ID NO: 24)
```
   1 melaalcrwg lllallppga astqvctgtd mklrlpaspe thldmlrhly qgcqvvqgnl
```

-continued

```
 61 eltylptnas lsflqdiqev qgyvliahnq vrqvplqrlr ivrgtqlfed nyalavldng
121 dplnnttpvt gaspggLrel qlrslteilk ggvliqrnpq lcyqdtilwk difhknnqla
181 ltlidtnrsr achpcspmck gsrcwgesse dcqsltrtvc aggcarckgp lptdccheqc
241 aagctgpkhs dclaclhfnh sgicelhcpa lvtyntdtfe smpnpegryt fgascvtacp
301 ynylstdvgs ctlvcplhnq evtaedgtqr cekcskpcar vcyglgmehl revravtsan
361 iqefagckki fgslaflpes fdgdpasnta plqpeqlqvf etleeitgyl yisawpdslp
421 dlsvfqnlqv irgrilhnga ysltlqglgi swlglrslre lgsglalihh nthlcfvhtv
481 pwdqlfrnph qallhtanrp edecvgegla chqlcarghc wgpgptqcvn csqflrgqec
541 veecrvlqgl preyvnarhc lpchpecqpq ngsvtcfgpe adqcvacahy kdppfcvarc
601 psgvkpdlsy mpiwkfpdee gacqpcpinc thscvdlddk gcpaeqrasp ltsiisavvg
661 illvvvlgvv fgilikrrqq kirkytmrrl lqetelvepl tpsgampnqa qmrilketel
721 rkvkvlgsga fgtvykgiwi pdgenvkipv aikvlrents pkankeilde ayvmagvgsp
781 yvsrllgicl tstvqlvtql mpygclldhv renrgrlgsq dllnwcmqia kgmsyledvr
841 lvhrdlaarn vlvkspnhvk itdfglarll didetevhad ggkvpikwma lesilrrrft
901 hqsdvwsygv tvwelmtfga kpydgipare ipdllekger lpqppictid vymimvkcwm
961 idsecrprfr elvsefsrma rdpqrfvviq nedlgpaspl dstfyrslle dddmgdlvda
1021 eeylvpqqgf fcpdpapgag gmvhhrhrss strnm
```

Receptor tyrosine-protein kinase erbB-2, isoform e, NP_001276867.1

(SEQ ID NO: 25)

```
  1 mklrlpaspe thldmlrhly qgcqvvqgnl eltylptnas lsflqdiqev qgyvliahnq
 61 vrqvplqrlr ivrgtqlfed nyalavldng dplnnttpvt gaspggLrel qlrslteilk
121 ggvliqrnpq lcyqdtilwk difhknnqla ltlidtnrsr achpcspmck gsrcwgesse
181 dcqsltrtvc aggcarckgp lptdccheqc aagctgpkhs dclaclhfnh sgicelhcpa
241 lvtyntdtfe smpnpegryt fgascvtacp ynylstdvgs ctlvcplhnq evtaedgtqr
301 cekcskpcar vcyglgmehl revravtsan iqefagckki fgslaflpes fdgdpasnta
361 plqpeqlqvf etleeitgyl yisawpdslp dlsvfqnlqv irgrilhnga ysltlqglgi
421 swlglrslre lgsglalihh nthlcfvhtv pwdqlfrnph qallhtanrp edecvgegla
481 chqlcarghc wgpgptqcvn csqflrgqec veecrvlqgl preyvnarhc lpchpecqpq
541 ngsvtcfgpe adqcvacahy kdppfcvarc psgvkpdlsy mpiwkfpdee gacqpcpinc
601 ths
```

Inosine monophosphate dehydrogenase 2, NP_000875.2

(SEQ ID NO: 26)

```
  1 madylisggt syvpddglta qqlfncgdgl tyndflilpg yidftadqvd ltsaltkkit
 61 lktplvsspm dtvteagmai amaltggigf ihhnctpefq anevrkvkky eqgfitdpvv
121 lspkdrvrdv feakarhgfc gipitdtgrm gsrlvgiiss rdidflkeee hdcfleeimt
181 kredlvvapa gitlkeanei lqrskkgklp ivneddelva iiartdlkkn rdyplaskda
241 kkqllcgaai gtheddkyrl dllaqagvda vvldssqgns ifqinmikyi kdkypnlqvi
301 ggnvvtaaqa knlidagvda lrvgmgsgsi citqevlacg rpqatavykv seyarrfgvp
361 viadggiqnv ghiakalalg astvmmgsll aatteapgey ffsdgirlkk yrgmgsldam
421 dkhlssqnry fseadkikva qgvsgavqdk gsihkfvpyl iagiqhscqd igaksltqvr
481 ammysgelkf ekrtssaqve ggvhslhsye krlf
```

KRAS proto-oncogene, GTPase, isoform a, NP_203524.1

(SEQ ID NO: 27)

```
  1 mteyklvvvg aggvgksalt iqliqnhfvd eydptiedsy rkqvvidget clldildtag
```

```
 61 qeeysamrdq ymrtgegflc vfainntksf edihhyreqi krvkdsedvp mvlvgnkcdl 121 psrtvdtkqa qdlarsygip fietsaktrq rvedafytlv reirqyrlkk iskeektpgc 181 vkikkciim
```

KRAS proto-oncogene, GTPase, isoform b, NP_004976.2
(SEQ ID NO: 28)
```
  1 mteyklvvvg aggvgksalt iqliqnhfvd eydptiedsy rkqvvidget clldildtag 61 qeeysamrdq ymrtgegflc vfainntksf edihhyreqi krvkdsedvp mvlvgnkcdl 121 psrtvdtkqa qdlarsygip fietsaktrq gvddafytlv reirkhkekm skdgkkkkkk 181 sktkcvim
```

Transforming growth factor beta receptor 2, isoform A precursor,
NP_001020018.1
(SEQ ID NO: 29)
```
  1 mgrgllrglw plhivlwtri astipphvqk sdvemeaqkd eiicpscnrt ahplrhinnd 61 mivtdnngav kfpqlckfcd vrfstcdnqk scmsncsits icekpqevcv avwrkndeni 121 tletvchdpk lpyhdfiled aaspkcimke kkkpgetffm cscssdecnd niifseeynt 181 snpdlllvif qvtgisllpp lgvaisviii fycyrvnrqq klsstwetgk trklmefseh 241 caileddrs disstcanni nhntellpie ldtlvgkgrf aevykaklkq ntseqfetva 301 vkifpyeeya swktekdifs dinlkhenil qfltaeerkt elgkqywlit afhakgnlqe 361 yltrhviswe dlrklgssla rgiahlhsdh tpcgrpkmpi vhrdlkssni lvkndltccl 421 cdfglslrld ptlsvddlan sgqvgtarym apevlesrmn lenvesfkqt dvysmalvlw 481 emtsrcnavg evkdyeppfg skvrehpcve smkdnvlrdr grpeipsfwl nhqgiqmvce 541 tltecwdhdp earltaqcva erfselehld rlsgrscsee kipedgslnt tk
```

Transforming growth factor beta receptor 2, isoform B precursor,
NP_003233.4
(SEQ ID NO: 30)
```
  1 mgrgllrglw plhivlwtri astipphvqk svnndmivtd nngavkfpql ckfcdvrfst 61 cdnqkscmsn csitsicekp qevcvavwrk ndenitletv chdpklpyhd filedaaspk 121 cimkekkkpg etffmcscss decndniifs eeyntsnpdl llvifqvtgi sllpplgvai 181 sviiifycyr vnrqqklsst wetgktrklm efsehcaiil eddrsdisst canninhnte 241 llpieldtlv gkgrfaevyk aklkqntseq fetvavkifp yeeyaswkte kdifsdinlk 301 henilqflta eerktelgkq ywlitafhak gnlqeyltrh viswedlrkl gsslargiah 361 lhsdhtpcgr pkmpivhrdl kssnilvknd ltcclcdfgl slrldptlsv ddlansgqvg 421 tarymapevl esrmnlenve sfkqtdvysm alvlwemtsr cnavgevkdy eppfgskvre 481 hpcvesmkdn vlrdrgrpei psfwlnhqgi qmvcetltec wdhdpearlt aqcvaerfse 541 lehldrlsgr scseekiped gslnttk
```

Actinin alpha 4, isoform 1, NP_004915.2
(SEQ ID NO: 31)
```
  1 mvdyhaanqs yqygpssagn gagggsmgd ymaqeddwdr dllldpawek qqrktftawc 61 nshlrkagtq ienidedfrd glklmlllev isgerlpkpe rgkmrvhkin nvnkaldfia 121 skgvklvsig aeeivdgnak mtlgmiwtii lrfaiqdisv eetsakegll lwcqrktapy 181 knvnvqnfhi swkdglafna lihrhrpeli eydklrkddp vtnlnnafev aekyldipkm 241 ldaedivnta rpdekaimty vssfyhafsg aqkaetaanr ickvlavnqe nehlmedyek 301 lasdllewir rtipwledrv pqktiqemqq kledfrdyrr vhkppkvqek cqleinfntl 361 qtklrlsnrp afmpsegkmv sdinngwqhl eqaekgyeew llneirrler ldhlaekfrq 421 kasiheawtd gkeamlkhrd yetatlsdik alirkheafe sdlaahqdrv eqiaaiaqel
```

-continued

```
481 neldyydshn vntrcqkicd qwdalgslth srrealekte kqleaidqlh leyakraapf 541 nnwmesamed lqdmfivhti eeieglisah dqfkstlpda drereailai hkeaqriaes 601 nhiklsgsnp yttvtpqiin skwekvqqlv pkrdhallee qskqqsnehl rrqfasqanv 661 vgpwiqtkme eigrisiemn gtledqlshl kqyersivdy kpnldlleqq hqliqealif 721 dnkhtnytme hirvgweqll ttiartinev enqiltrdak gisqegmqef rasfnhfdkd 781 hggalgpeef kaclislgyd vendrqgeae fnrimslvdp nhsglvtfqa fidfmsrett 841 dtdtadqvia sfkvlagdkn fitaeelrre lppdqaeyci armapyqgpd avpgaldyks 901 fstalygesd l
```

Actinin alpha 4, isoform 2, NP_001308962.1

(SEQ ID NO: 32)
```
  1 mvdyhaanqs yqygpssagn gaggggsmgd ymaqeddwdr dllldpawek qqrktftawc 61 nshlrkagtq ienidedfrd glklmlllev isgerlpkpe rgkmrvhkin nvnkaldfia 121 skgvklvsig aeeivdgnak mtlgmiwtii lrfaiqdisv eetsakegll lwcqrktapy 181 knvnvqnfhi swkdglafna lihrhrpeli eydklrkddp vtnlnnafev aekyldipkm 241 ldaedivgtl rpdekaimty vscfyhafsg aqkaetaanr ickvlavnqe nehlmedyek 301 lasdllewir rtipwledrv pqktiqemqq klcdfrdyrr vhkppkvqek cgleinfntl 361 qtklrlsnrp afmpsegkmv sdinngwqhl eqaekgyeew llneirrler ldhlaekfrq 421 kasiheawtd gkeamlkhrd yetatlsdik alirkheafe sdlaahqdrv eqiaaiaqel 481 neldyydshn vntrcqkicd qwdalgslth srrealekte kqleaidqlh leyakraapf 541 nnwmesamed lqdmfivhti eeieglisah dqfkstlpda drereailai hkeaqriaes 601 nhiklsgsnp yttvtpqiin skwekvqqlv pkrdhallee qskqqsnehl rrqfasqanv 661 vgpwiqtkme eigrisiemn gtledqlshl kqyersivdy kpnldlleqq hqliqealif 721 dnkhtnytme hirvgweqll ttiartinev enqiltrdak gisqegmqef rasfnhfdkk 781 qtgsmdsddf rallistgys lgeaefnrim slvdpnhsgl vtfqafidfm srettdtdta 841 dqviasfkvl agdknfitae elrrelppdq aeyciarmap yqgpdavpga ldyksfstal 901 ygesdl
```

Activin A receptor type 1, NP_001096.1, NP_001104537.1,
NP_001334592.1, NP_001334593.1, NP_001334594.1, NP_001334595.1,
NP_001334596.1

(SEQ ID NO: 33)
```
  1 mvdgvmilpv limialpsps medekpkvnp klymcvcegl scgnedhceg qqcfsslsin 61 dgfhvyqkgc fqvyeqgkmt cktppspgqa veccqgdwcn rnitaqlptk gksfpgtqnf 121 hlevgliils vvfavcllac llgvalrkfk rrnqerlnpr dveygtiegl ittnvgdstl 181 adlldhscts gsgsglpflv qrtvarqitl lecvgkgryg evwrgswqge nvavkifssr 241 dekswfrete lyntvmlrhe nilgfiasdm tsrhsstqlw lithyhemgs lydylqlttl 301 dtvsclrivl siasglahlh ieifgtqgkp aiahrdlksk nilvkkngqc ciadlglavm 361 hsqstnqldv gnnprvgtkr ymapevldet iqvdcfdsyk rvdiwafglv lwevarrmvs 421 ngivedykpp fydvvpndps fedmrkvvcv dqqrpnipnr wfsdptltsl aklmkecwyq 481 npsarltalr ikktltkidn sldklktdc
```

Alcohol dehydrogenase 1C (class I), gamma polypeptide, NP_000660.1

(SEQ ID NO: 34)
```
  1 mstagkvikc kaavlwelkk pfsieeveva ppkahevrik mvaagicrsd ehvvsgnlvt 61 plpvilghea agivesvgeg vttvkpgdkv iplftpqcgk cricknpesn yclkndlgnp 121 rgtlqdgtrr ftcsgkpihh fvgvstfsqy tvvdenavak idaasplekv cligcgfstg 181 ygsavkvakv tpgstcavfg lggvglsvvm gckaagaari iavdinkdkf akakelgate
```

```
241 cinpqdykkp iqevlkemtd ggvdfsfevi grldtmmasl lccheacgts vivgvppdsq 301 nlsinpmlll tgrtwkgaif ggfkskesvp klvadfmakk fsldalitni lpfekinegf 361 dllrsgksir tvltf
```

Adenosine A2a receptor, NP_000666.2, NP_001265426.1,
NP_001265427.1, NP_001265428.1, NP_001265429.1
(SEQ ID NO: 35)

```
  1 mpimgssvyi tvelaiavla ilgnvlvcwa vwlnsnlqnv tnyfvvslaa adiavgvlai 61 pfaitistgf caachgclfi acfvlvltqs sifsllaiai dryiairipl rynglvtgtr 121 akgiiaicwv lsfaigltpm lgwnncgqpk egknhsqgcg egqvaclfed vvpmnymvyf 181 nffacvlvpl llmlgvylri flaarrqlkq mesqplpger arstlqkevh aakslaiivg 241 lfalcwlplh iincftffcp dcshaplwlm ylaivlshtn svvnpfiyay rirefrqtfr 301 kiirshvlrq qepfkaagts arvlaahgsd geqvslrlng hppgvwangs aphperrpng 361 yalglvsggs aqesqgntgl pdvellshel kgvcpeppgl ddplaqdgag vs
```

Rho guanine nucleotide exchange factor 16, NP_055263.2
(SEQ ID NO: 36)

```
  1 maqrhsdssl eekllghrfh selrldaggn pasglpmvrg sprvrddaaf qpqvpappqp 61 rppgheepwp ivlstespaa lklgtqqlip kslavaskak tparhqsfga avlsreaarr 121 dpkllpapsf slddmdvdkd pggmlrrnlr nqsyraamkg lgkpggqgda iqlspklqal 181 aeepsqphtr spaknkktlg rkrghkgsfk ddpqlyqeiq erglntsqes dddildesss 241 pegtqkvdat ivvksyrpaq vtwsqlpevv elgildqlst eerkrqeamf eiltsefsyq 301 hslsilveef lqskelratv tqmehhhlfs nildvlgasq rffedleqrh kaqvlvedis 361 dileehaekh fhpyiaycsn evyqqrtlqk lissnaafre alreierrpa cgglpmlsfl 421 ilpmqrvtrl pllmdtlclk tqghseryka asralkaisk lvrqcnegah rmermeqmyt 481 lhtqldfskv kslplisasr wllkrgelfl veetglfrki asrptcylfl fndvlvvtkk 541 kseesymvqd yaqmnhiqve kiepselplp gggnrsssvp hpfqvtllrn segrqeqlll 601 ssdsasdrar wivalthser qwqglsskgd lpqveitkaf fakqadevtl qqadvvlvlq 661 qedgwlyger lrdgetgwfp edfarfitsr vavegnvrrm erlrvetdv
```

B-cell linker, isoform 1, NP_037446.1
(SEQ ID NO: 37)

```
  1 mdklnkitvp asqklrqlqk mvhdiknneg gimnkikklk vkappsvprr dyasespade 61 eeqwsddfds dyenpdehsd semyvmpaee naddsyeppp veqetrpvhp alpfargeyi 121 dnrssqrhsp pfsktlpskp swpsekarlt stlpaltalq kpqvppkpkg lledeadyvv 181 pvedndenyi hptesssppp ekapmvnrst kpnsstpasp pgtasgrnsg awetkspppa 241 apsplpragk kpttplkttp vasqqnassv ceekpipaer hrgsshrqea vqspvfppaq 301 kqihqkpipl prfteggnpt vdgplpsfss nstiseqeag vlckpwyaga cdrksaeeal 361 hrsnkdgsfl irkssghdsk qpytlvvffn krvynipvrf ieatkqyalg rkkngeeyfg 421 svaeiirnhq hsplvlidsq nntkdstrlk yavkvs
```

B-cell linker, isoform 2, NP_001107566.1
(SEQ ID NO: 38)

```
  1 mdklnkitvp asqklrqlqk mvhdiknneg gimnkikklk vkappsvprr dyasespade 61 eeqwsddfds dyenpdehsd semyvmpaee naddsyeppp veqetrpvhp alpfargeyi 121 dnrssqrhsp pfsktlpskp swpsekarlt stlpaltalq kpqvppkpkg lledeadyvv 181 pvedndenyi hptesssppp ekgrnsgawe tkspppaaps plpragkkpt tplkttpvas 241 qqnassvcee kpipaerhrg sshrqeavqs pvfppaqkqi hqkpiplprf teggnptvdg 301 plpsfssnst iseqeagvlc kpwyagacdr ksaeealhrs nkdgsflirk ssghdskqpy
```

B-cell linker, isoform 3, NP_001245369.1

(SEQ ID NO: 39)

```
  1 mdklnkitvp asqklrqlqk mvhdiknneg gimnkikklk vkappsvprr dyasespade
 61 eeqwsddfds dyenpdehsd semyvmpaee naddsyeppp veqetrpvhp alpfargeyi
121 dnrssqrhsp pfsktlpskp swpsekarlt stlpaltalq kpqvppkpkg lledeadyvv
181 pvedndenyi hptesssppp ekapmvnrst kpnsstpasp pgtasgrnsg awetkspppa
241 apsplpragk kpttplkttp vasqqnassv ceekpipaer hrgsshrqea vqspvfppaq
301 kqihqkpipl prfteggnpt vdgplpsfss nstiseqeag vlckpwyaga cdrksaeeal
361 hrsnkyfgsv aeiirnhqhs plvlidsqnn tkdstrlkya vkvs
```

B-cell linker, isoform 4, NP_001245370.1

(SEQ ID NO: 40)

```
  1 mdklnkitvp asqklrqlqk mvhdiknneg gimnkikklk vkappsvprr dyasespade
 61 eeqwsddfds dyenpdehsd semyvmpaee naddsyeppp veqetrpvhp alpfargeyi
121 dnrssqrhsp pfsktlpskp swpsekarlt stlpaltalq kpqvppkpkg lledeadyvv
181 pvedndenyi hptesssppp ekgrnsgawe tksppapaps plpragkkpt tplkttpvas
241 qqnassvcee kpipaerhrg sshrqeavqs pvfppaqkqi hqkpiplprf teggnptvdg
301 plpsfssnst iseqeagvlc kpwyagacdr ksaeealhrs nkyfgsvaei irnhqhsplv
361 lidsqnntkd strlkyavkv s
```

B-cell linker, isoform 5, NP_001245371.1

(SEQ ID NO: 41)

```
  1 mdklnkitvp asqklrqlqk mvhdiknneg gimnkikklk vkappsvprr dyasespade
 61 eeqwsddfds dyenpdehsd semyvmpaee naddsyeppp veqetrpvhp alpfargtas
121 grnsgawetk spppaapspl pragkkpttp lkttpvasqq nassvceekp ipaerhrgss
181 hrqeavqspv fppaqkqihq kpiplprfte ggnptvdgpl psfssnstis eqeagvlckp
241 wyagacdrks aeealhrsnk yfgsvaeiir nhqhsplvli dsqnntkdst rlkyavkvs
```

Basonuclin 1, isoform a, NP_001708.3

(SEQ ID NO: 42)

```
  1 mrrrppsrgg rgaararetr rqprhrsgrr maeaisctln cscqsfkpgk inhrqcdqck
 61 hgwvahalsk lrippmypts qveivqsnvv fdisslmlyg tqaipvrlki lldrlfsvlk
121 qdevlqilha ldwtlqdyir gyvlqdasgk vldhwsimts eeevatlqqf lrfgetksiv
181 elmaiqekee qsiiippsta nvdirafies cshrssslpt pvdkgnpssi hpfenlisnm
241 tfmlpfqffn plppaligsl peqymleqgh dqsqdpkqev hgpfpdssfl tssstpfqve
301 kdqclncpda itkkedsthl sdsssynivt kfertqlspe akvkpernsl gtkkgrvfct
361 acektfydkg tlkihynavh lkikhkctie gcnmvfsslr srnrhsanpn prlhmpmnrn
421 nrdkdlrnsl nlassenykc pgftvtspdc rpppsypgsg edskggpafp nigqngvlfp
481 nlktvqpvlp fyrspatpae vantpgilps lpllsssipe qlisnempfd alpkkksrks
541 smpikiekea veianekrhn lssdedmplq vvsedeqeac spqshrvsee qhvqsgglgk
601 pfpegerpch resviessga isqtpeqath nsereteqtp alimpreve dgghehyftp
661 gmepqvpfsd ymelqqrlla gglfsalsnr gmafpcleds kelehvgqha larqieenrf
721 qcdickktfk nacsvkihhk nmhvkemhtc tvegcnatfp srrsrdrhss nlnlhqkals
781 qealessedh fraayllkdv akeayqdvaf tqqasqtsvi fkgtsrmgsl vypitqvhsa
841 slesynsgpl segtildlst tssmksesss hsswdsdgvs eegtvlmeds dgncegsslv
```

-continued

```
901 pgedeypicv lmekadqsla slpsglpitc hlcqktysnk gtfrahyktv hlrqlhkckv 961 pgcntmfssv rsrnrhsqnp nlhkslassp shlq
```

Basonuclin 1, isoform b, NP_001288135.1
(SEQ ID NO: 43)

```
  1 mrcrnmffsf kaslcgcgaa tapsltaisc tlncscqsfk pgkinhrqcd qckhgwvaha 61 lsklrippmy ptsqveivqs nvvfdisslm lygtqaipvr lkilldrlfs vlkqdevlqi 121 lhaldwtlqd yirgyvlqda sgkvldhwsi mtseeevatl qqflrfgetk sivelmaiqe 181 keeqsiiipp stanvdiraf iescshrsss lptpvdkgnp ssihpfenli snmtfmlpfq 241 ffnplppali gslpeqymle qghdqsqdpk qevhgpfpds sfltssstpf qvekdqclnc 301 pdaitkkeds thlsdsssyn ivtkfertql speakvkper nslgtkkgrv fctacektfy 361 dkgtlkihyn avhlkikhkc tiegcnmvfs slrsrnrhsa npnprlhmpm nrnnrdkdlr 421 nslnlassen ykcpgftvts pdcrpppsyp gsgedskgqp afpnigqngv lfpnlktvqp 481 vlpfyrspat paevantpgi lpslpllsss ipeqlisnem pfdalpkkks rkssmpikie 541 keaveianek rhnlssdedm plqvvsedeq eacspqshrv seeqhvgsgg lgkpfpeger 601 pchresvies sgaisqtpeq athnserete qtpalimvpr evedgghehy ftpgmepqvp 661 fsdymelqqr llagglfsal snrgmafpcl edskelehvg ghalargiee nrfqcdickk 721 tfknacsvki hhknmhvkem htctvegcna tfpsrrsrdr hssnlnlhqk alsqealess 781 edhfraayll kdvakeayqd vaftqqasqt svifkgtsrm gslvypitqv hsaslesyns 841 gplsegtild lsttssmkse ssshsswdsd gvseegtvlm edsdgncegs slvpgedeyp 901 icvlmekadq slaslpsglp itchlcqkty snkgtfrahy ktvhlrqlhk ckvpgcntmf 961 ssvrsrnrhs qnpnlhksla sspshlq
```

BPI fold containing family A member 1, precursor, NP_001230122.1, NP_057667.1, NP_570913.1
(SEQ ID NO: 44)

```
  1 mfqtgglivf ygllaqtmaq fgglpvpldq tlpinvnpal plsptglags ltnalsngll 61 sggllgilen lplldilkpg ggtsggllgg llgkvtsvip glnniidikv tdpqllelgl 121 vqspdghrly vtiplgiklq vntplvgasl lrlavkldit aeilavrdkq erihlvlgdc 181 thspgslqis lldglgplpi qglldsltgi lnkvlpelvq gnvcplvnev lrglditivh 241 divnmlihgl qfvikv
```

Calcium voltage-gated channel auxiliary subunit beta 3, isoform 1, NP_000716.2
(SEQ ID NO: 45)

```
  1 myddsyvpgf edseagsads ytsrpsldsd vsleedresa rrevesqaqq qlerakhkpv 61 afavrtnvsy cgvldeecpv qgsgvnfeak dflhikekys ndwwigrlvk eggdiafips 121 pqrlesirlk qeqkarrsgn pssslsdignr rspppslakq kqkqaehvpp ydvvpsmrpv 181 vlvgpslkgy evtdmmqkal fdflkhrfdg risitrvtad lslakrsvln npgkrtiier 241 ssarssiaev qseierifel akslqlvvld adtinhpaql aktslapiiv fvkvsspkvl 301 qrlirsrgks qmkhltvqmm aydklvqcpp esfdvilden qledacehla eylevywrat 361 hhpapgpgll gppsaipglq nqqllgerge ehsplerdsl mpsdeasess rqawtgssqr 421 ssrhleedya dayqdlyqph rqhtsglpsa nghdpqdrll aqdsehnhsd rnwqrnrpwp 481 kdsy
```

Calcium voltage-gated channel auxiliary subunit beta 3, isoform 2, NP_001193844.1
(SEQ ID NO: 46)

```
  1 myddsyvpgf edseagsads ytsrpsldsd vsleedresa rrevesqaqq qlerakkysn 61 dwwigrlvke ggdiafipsp qrlesirlkq eqkarrsgnp ssslsdignrr spppslakqk
```

-continued

```
121 qkqaehvppy dvvpsmrpvv lvgpslkgye vtdmmqkalf dflkhrfdgr isitrvtadl 181 slakrsvlnn pgkrtiiers sarssiaevq seierifela kslqlvvlda dtinhpaqla 241 ktslapiivf vkvsspkvlq rlirsrgksq mkhltvqmma ydklvqcppe sfdvildenq 301 ledacehlae ylevywrath hpapgpgllg ppsaipglqn qqllgergee hsplerdslm 361 psdeasessr qawtgssqrs srhleedyad ayqdlyqphr qhtsglpsan ghdpqdrlla 421 qdsehnhsdr nwqrnrpwpk dsy
```

Calcium voltage-gated channel auxiliary subunit beta 3, isoform 3, NP_001193845.1
(SEQ ID NO: 47)

```
  1 msfsdssatf llnegsadsy tsrpsldsdv sleedresar revesqaqqq lerakhkpva 61 favrtnvsyc gvldeecpvq gsgvnfeakd flhikekysn dwwigrlvke ggdiafipsp 121 qrlesirlkq eqkarrsgnp sslsdignrr spppslakqk qkqaehvppy dvvpsmrpvv 181 lvgpslkgye vtdmmqkalf dflkhrfdgr isitrvtadl slakrsvlnn pgkrtiiers 241 sarssiaevq seierifela kslqlvvlda dtinhpaqla ktslapiivf vkvsspkvlq 301 rlirsrgksq mkhltvqmma ydklvqcppe sfdvildenq ledacehlae ylevywrath 361 hpapgpgllg ppsaipglqn qqllgergee hsplerdslm psdeasessr qawtgssqrs 421 srhleedyad ayqdlyqphr qhtsglpsan ghdpqdrlla qdsehnhsdr nwqrnrpwpk 481 dsy
```

Calcium voltage-gated channel auxiliary subunit beta 3, isoform 4, NP_001193846.1
(SEQ ID NO: 48)

```
  1 megsadsyts rpsldsdvsl eedresarre vesqaqqqle rakhkpvafa vrtnvsycgv 61 ldeecpvqgs gvnfeakdfl hikekysndw wigrlvkegg diafipspqr lesirlkqeq 121 karrsgnpss lsdignrrsp ppslakqkqk qaehvppydv vpsmrpvvlv gpslkgyevt 181 dmmqkalfdf lkhrfdgris itrvtadlsl akrsvinnpg krtiierssa rssiaevqse 241 ierifelaks lqlvvldadt inhpaqlakt slapiivfvk vsspkvlqrl irsrgksqmk 301 hltvqmmayd klvqcppesf dvildenqle dacehlaeyl evywrathhp apgpgllgpp 361 saipglqnqq llgergeehs plerdslmps deasessrqa wtgssqrssr hleedyaday 421 qdlyqphrqh tsglpsangh dpqdrllaqd sehnhsdrnw qrnrpwpkds y
```

Caspase 3, preproprotein, NP_001341706.1, NP_001341707.1, NP_004346.3, NP_116786.1
(SEQ ID NO: 49)

```
  1 mentensvds ksiknlepki ihgsesmdsg isldnsykmd ypemglciii nnknfhkstg 61 mtsrsgtdvd aanlretfrn lkyevrnknd ltreeivelm rdvskedhsk rssfvcvlls 121 hgeegiifgt ngpvdlkkit nffrgdrcrs ltgkpklfii qacrgteldc gietdsgvdd 181 dmachkipve adflyaysta pgyyswrnsk dgswfiqslc amlkqyadkl efmhiltrvn 241 rkvatefesf sfdatfhakk qipcivsmlt kelyfyh
```

Caspase 3, isoform b, NP_001341708.1, NP001341709.1
(SEQ ID NO: 50)

```
  1 mdsgisldns ykmdypemgl ciiinnknfh kstgmtsrsg tdvdaanlre tfrnlkyevr 61 nkndltreei velmrdvske dhskrssfvc vllshgeegi ifgtngpvdl kkitnffrgd 121 rcrsltgkpk lfiiqacrgt eldcgietds gvdddmachk ipveadflya stapgyysw 181 rnskdgswfi qslcamlkqy adklefmhil trvnrkvate fesfsfdatf hakkgipciv 241 smltkelyfy h
```

Caspase 3, isoform c, NP_001341710.1, NP001341711.1
(SEQ ID NO: 51)

```
  1 mentensvds ksiknlepki ihgsesmdsg isldnsykmd ypemglciii nnknfhkstg
```

-continued

```
  61 mtsrsgtdvd aanlretfrn lkyevrnknd ltreeivelm rdvskedhsk rssfvcvlls 121 hgeegiifgt ngpvdlkkit nffrgdrcrs ltgkpklfii qviilgeiqr mapgsssrfv 181 pc
```

Caspase 3, isoform d, NP_001341712.1
(SEQ ID NO: 52)
```
   1 msdalikvsm entensvdsk siknlepkii hgsesmdsgi sldnsykmdy pemglciiin 61 nknfhkstgm tsrsgtdvda anlretfrnl kyevrnkndl treeivelmr dvskedhskr 121 ssfvcvllsh geegiifgtn gpvdlkkitn ffrgdrcrsl tgkpklfiiq viilgeiqrm 181 apgsssrfvp c
```

Caspase 3, isoform e, NP_001341713.1
(SEQ ID NO: 53)
```
   1 mdsgisldns ykmdypemgl ciiinnknfh kstgmtsrsg tdvdaanlre tfrnlkyevr 61 nkndltreei velmrdvske dhskrssfvc vllshgeegi ifgtngpvdl kkitnffrgd 121 rcrsltgkpk lfiiqviilg eiqrmapgss srfvpc
```

Caveolin 1, isoform alpha, NP_001744.2
(SEQ ID NO: 54)
```
   1 msggkyvdse ghlytvpire qgniykpnnk amadelsekq vydahtkeid lvnrdpkhln 61 ddvvkidfed viaepegths fdgiwkasft tftvtkywfy rllsalfgip maliwgiyfa 121 ilsflhiwav vpciksflie iqcisrvysi yvhtvcdplf eavgkifsnv rinlqkei
```

Caveolin 1, isoform beta, NP_001166366.1, NP_001166367.1,
NP_001166368.1
(SEQ ID NO: 55)
```
   1 madelsekqv ydahtkeidl vnrdpkhlnd dvvkidfedv iaepegthsf dgiwkasftt 61 ftvtkywfyr llsalfgipm aliwgiyfai lsflhiwavv pciksfliei qcisrvysiy 121 vhtvcdplfe avgkifsnvr inlqkei
```

Cadherin 1, isoform 1 preproprotein, NP_004351.1
(SEQ ID NO: 56)
```
   1 mgpwsrslsa llllqvssw lcqepepchp gfdaesytft vprrhlergr vlgrvnfedc 61 tgrqrtayfs ldtrfkvgtd gvitvkrplr fhnpqihflv yawdstyrkf stkvtlntvg 121 hhhrppphqa svsgiqaell tfpnsspglr rqkrdwvipp iscpenekgp fpknlvqiks 181 nkdkegkvfy sitgqgadtp pvgvfiiere tgwlkvtepl dreriatytl fshavssngn 241 avedpmeili tvtdqndnkp eftqevfkgs vmegalpgts vmevtatdad ddvntynaai 301 aytilsqdpe lpdknmftin rntgvisvvt tgldresfpt ytivvqaadl qgeglsttat 361 avitvtdtnd nppifnptty kgqvpenean vvittlkvtd adapntpawe avytilnddg 421 gqfvvttnpv nndgilktak gldfeakqqy ilhvavtnvv pfevslttst atvtvdvldv 481 neapifvppe krvevsedfg vgqeitsyta qepdtfmeqk ityriwrdta nwleinpdtg 541 aistraeldr edfehvknst ytaliiatdn gspvatgtgt lllilsdvnd napipeprti 601 ffcernpkpq viniidadlp pntspftael thgasanwti qyndptqesi ilkpkmalev 661 gdykinlklm dnqnkdqvtt levsvcdceg aagvcrkaqp veaglqipai lgilggilal 721 lililllllf lrrravvkep llppeddtrd nvyyydeegg geedqdfdls qlhrgldarp 781 evtrndvapt lmsvprylpr panpdeignf idenlkaadt dptappydsl lvfdyegsgs 841 eaaslsslns sesdkdqdyd ylnewgnrfk kladmyggge dd
```

Cadherin 1, isoform 2 precursor, NP_001304113.1
(SEQ ID NO: 57)
```
   1 mgpwsrslsa llllqvssw lcqepepchp gfdaesytft vprrhlergr vlgrvnfedc 61 tgrqrtayfs ldtrfkvgtd gvitvkrplr fhnpqihflv yawdstyrkf stkvtlntvg 121 hhhrppphqa sysgiqaell tfpnsspglr rqkrdwvipp iscpenekgp fpknlvqiks
```

-continued

```
181 nkdkegkvfy sitgqgadtp pvgvfiiere tgwlkvtepl dreriatytl fshayssngn 241 avedpmeili tvtdqndnkp eftqevfkgs vmegalpgts vmevtatdad ddvntynaai 301 aytilsqdpe lpdknmftin rntgvisvvt tgldresfpt ytlvvqaadl qgeglsttat 361 avitvtdtnd nppifnpttg ldfeakqqyi lhvavtnvvp fevslttsta tvtvdvldvn 421 eapifvppek rvevsedfgv gqeitsytaq epdtfmeqki tyriwrdtan wleinpdtga 481 istraeldre dfehvknsty taliiatdng spvatgtgtl llilsdvndn apipeprtif 541 fcernpkpqv iniidadlpp ntspftaelt hgasanwtiq yndptqesii lkpkmalevg 601 dykinlklmd nqnkdqvttl evsvcdcega agvcrkagpv eaglqipail gilggilall 661 ilillllfl rrravvkepl lppeddtrdn vyyydeeggg eedqdfdlsq lhrgldarpe 721 vtrndvaptl msvprylprp anpdeignfi denlkaadtd ptappydsll vfdyegsgse 781 aaslsslnss esdkdqdydy lnewgnrfkk ladmyggged d
```

Cadherin 1, isoform 3, NP_001304114.1
(SEQ ID NO: 58)
```
  1 meqkityriw rdtanwlein pdtgaistra eldredfehv knstytalii atdngspvat 61 gtgtllllils dvndnapipe prtiffcern pkpqviniid adlppntspf taelthgasa 121 nwtiqyndpt qesiilkpkm alevgdykin lklmdnqnkd qvttlevsvc dcegaagvcr 181 kaqpveaglq ipailgilgg ilallilill lllflrrrav vkepllpped dtrdnvyyyd 241 eegggeedqd fdlsqlhrgl darpevtrnd vaptlmsvpr ylprpanpde ignfidenlk 301 aadtdptapp ydsllvfdye gsgseaasls slnssesdkd qdydylnewg nrfkkladmy 361 gggedd
```

Cadherin 1, isoform 4, NP_001304115.1
(SEQ ID NO: 59)
```
  1 malevgdyki nlklmdnqnk dqvttlevsv cdcegaagvc rkaqpveagl qipailgilg 61 gilallilil llllflrrra vvkepllppe ddtrdnvyyy deegggeedq dfdlsqlhrg 121 ldarpevtrn dvaptlmsvp rylprpanpd eignfidenl kaadtdptap pydsllvfdy 181 egsgseaasl sslnssesdk dqdydylnew gnrfkkladm ygggedd
```

Cytochrome c oxidase subunit 8C, NP_892016.1
(SEQ ID NO: 60)
```
  1 mpllrgrcpa rrhyrrlall glqpaprfah sgpprqrpls aaemavglvv ffttfltpaa 61 yvlgnlkqfr rn
```

Carnitine palmitoyltransferase 1A, isoform 1, NP_001867.2
(SEQ ID NO: 61)
```
  1 maeahqavaf qftvtpdgid lrlshealrq iylsglhswk kkfirfkngi itgvypasps 61 swlivvvgvm ttmyakidps lgiiakinrt letancmssq tknvvsgvlf gtglwvaliv 121 tmryslkvll syhgwmfteh gkmsratkiw mgmvkifsgr kpmlysfqts lprlpvpavk 181 dtvnrylqsv rplmkeedfk rmtalaqdfa vglgprlqwy lklkswwatn yvsdwweeyi 241 ylrgrgplmv nsnyyamdll yilpthiqaa ragnaihail lyrrkldree ikpirllgst 301 iplcsaqwer mfntsripge etdtiqhmrd skhivvyhrg ryfkvwlyhd grllkpreme 361 qqmqrildnt sepqpgearl aaltagdrvp warcrqayfg rgknkqslda vekaaffvtl 421 deteegyrse dpdtsmdsya ksllhgrcyd rwfdksftfv vfkngkmgln aehswadapi 481 vahlweyvms idslqlgyae dghckgdinp nipyptrlqw dipgecqevi etslntanll 541 andvdfhsfp fvafgkgiik kcrtspdafv qlalqlahyk dmgkfcltye asmtrlfreg 601 rtetvrsctt escdfvramv dpaqtveqrl klfklasekh qhmyrlamtg sgidrhlfcl 661 yvvskylave spflkevlse pwrlstsqtp qqqvelfdle nnpeyvssgg gfgpvaddgy 721 gvsyilvgen linfhisskf scpetdshrf grhlkeamtd iitlfglssn skk
```

Carnitine palmitoyltransferase 1A, isoform 2, NP_001027017.1

(SEQ ID NO: 62)

```
  1 maeahqavaf qftvtpdgid lrlshealrq iylsglhswk kkfirfkngi itgvypasps
 61 swlivvvgvm ttmyakidps lgiiakinrt letancmssq tknvvsgvlf gtglwvaliv
121 tmryslkvll syhgwmfteh gkmsratkiw mgmvkifsgr kpmlysfqts lprlpvpavk
181 dtvnrylqsv rplmkeedfk rmtalaqdfa vglgprlqwy lklkswwatn yvsdwweeyi
241 ylrgrgplmv nsnyyamdll yilpthiqaa ragnaihail lyrrkldree ikpirllgst
301 iplcsaqwer mfntsripge etdtiqhmrd skhivvyhrg ryfkvwlyhd grllkpreme
361 qqmqrildnt sepqpgearl aaltagdrvp warcrgayfg rgknkgslda vekaaffvtl
421 deteegyrse dpdtsmdsya ksllhgrcyd rwfdksftfv vfkngkmgln aehswadapi
481 vahlweyvms idslqlgyae dghckgdinp nipyptrlqw dipgecqevi etslntanll
541 andvdfhsfp fvafgkgiik kcrtspdafv qlalqlahyk dmgkfcltye asmtrlfreg
601 rtetvrsctt escdfvramv dpaqtveqrl klfklasekh qhmyrlamtg sgidrhlfcl
661 yvvskylave spflkevlse pwrlstsqtp qqqvelfdle nnpeyvssgg gfgpvaddgy
721 gvsyilvgen linfhisskf scpetgiisq gpssdt
```

Cancer/testis antigen 1A, NP_640343.1

(SEQ ID NO: 63)

```
  1 mqaegrgtgg stgdadgpgg pgipdgpggn aggpgeagat ggrgprgaga arasgpggga
 61 prgphggaas glngccrcga rgpesrllef ylampfatpm eaelarrsla qdapplpvpg
121 vllkeftvsg niltirltaa dhrqlqlsis sclqqlsllm witqcflpvf laqppsgqrr
```

C-X-C motif chemokine ligand 13, NP_006410.1

(SEQ ID NO: 64)

```
  1 mkfistslll mllvsslspv qgvlevyyts lrcrcvqess vfiprrfidr iqilprgngc
 61 prkeiivwkk nksivcvdpq aewiqrmmev lrkrssstlp vpvfkrkip
```

Diacylglycerol kinase eta, isoform 1, NP_001191433.1, NP_690874.2

(SEQ ID NO: 65)

```
   1 magaggqhhp pgaaggaaag agaavtsaaa sagpgedssd seaeqegpqk lirkvstsgq
  61 irtktsikeg qllkqtssfq rwkkryfklr grtlyyakds kslifdevdl sdasvaeast
 121 knannsftii tpfrrlmlca enrkemedwi sslksvqtre pyevaqfnve hfsgmhnwya
 181 csharptfcn vcreslsgvt shglscevck fkahkrcavr atnnckwttl asigkdiied
 241 edgvamphqw legnlpvsak cavcdktcgs vlrlqdwkcl wcktmvhtac kdlyhpicpl
 301 gqckvsiipp ialnstdsdg fcratfsfcv spllvfvnsk sgdnqgvkfl rrfkqllnpa
 361 qvfdlmnggp hlglrlfqkf dnfrilvcgg dgsvgwvlse idklnlnkqc qlgvlplgtg
 421 ndlarvlgwg gsydddtqlp qilekleras tkmldrwsim tyelklppka sllpgppeas
 481 eefymtiyed svathltkil nsdehavvis saktlcetvk dfvakvekty dktlenavva
 541 davaskcsvl nekleqllqa lhtdsqaapv lpglsplive edavesssee slgeskeqlg
 601 ddvtkpssqk avkpreimlr anslkkavrq vieeagkvmd dptvhpcepa nqssdydste
 661 tdeskeeakd dgakesitvk taprspdara syghsqtdsv pgpavaaske nlpvintrii
 721 cpglraglaa siagssiink mllanidpfg atpfidpdld svdgysekcv mnnyfgigld
 781 akislefnnk reehpekcrs rtknlmwygv lgtrellqrs yknleqrvql ecdgqyiplp
 841 slqgiavini psyaggtnfw ggtkeddifa apsfddkile vvaifdsmqm aysrviklqh
 901 hriaqcrtvk itifgdegvp vqvdgeawvq ppgiikivhk nraqmltrdr afestlkswe
 961 dkqkcdsgkp vlrthlyihh aidlateevs qmqlcsqaae elitricdaa tihclleqel
1021 ahavnacsha lnkanprcpe sltrdtatei ainvkalyne tesllvgrvp lqlespheer
```

-continued

```
1081 vsnalhsvev elqklteipw lyyilhpned eeppmdctkr nnrstvfriv pkfkkekvqk 1141 qktssqpgsg dtesgscean spgn
```

Diacylglycerol kinase eta, isoform 2, NP_821077.1

(SEQ ID NO: 66)

```
   1 magaggqhhp pgaaggaaag agaavtsaaa sagpgedssd seaeqegpqk lirkvstsgq 61 irtktsikeg qllkqtssfq rwkkryfklr grtlyyakds kslifdevdl sdasvaeast 121 knannsftii tpfrrlmlca enrkemedwi sslksvqtre pyevaqfnve hfsgmhnwya 181 csharptfcn vcreslsgvt shglscevck fkahkrcavr atnnckwttl asigkdiied 241 edgvamphqw legnlpvsak cavcdktcgs vlrlqdwkcl wcktmvhtac kdlyhpicpl 301 gqckvsiipp ialnstdsdg fcratfsfcv spllvfvnsk sgdnqgvkfl rrfkqllnpa 361 qvfdlmnggp hlglrlfqkf dnfrilvcgg dgsvgwvlse idklnlnkqc qlgvlplgtg 421 ndlarvlgwg gsydddtqlp qilekleras tkmldrwsim tyelklppka sllpgppeas 481 eefymtiyed svathltkil nsdehavvis sakticetvk dfvakvekty dktlenavva 541 davaskcsvl nekleqllqa lhtdsqaapv lpglsplive edavesssee slgeskeqlg 601 ddvtkpssqk avkpreimlr anslkkavrq vieeagkvmd dptvhpcepa nqssdydste 661 tdeskeeakd dgakesitvk taprspdara syghsqtdsv pgpavaaske nlpvintrii 721 cpglraglaa siagssiink mllanidpfg atpfidpdld svdgysekcv mnnyfgigld 781 akislefnnk reehpekcrs rtknlmwygv lgtrellqrs yknleqrvql ecdgqyiplp 841 slqgiavini psyaggtnfw ggtkeddifa apsfddkile vvaifdsmqm aysrviklqh 901 hriaqcrtvk itifgdegvp vqvdgeawvq ppgiikivhk nraqmltrdr afestlkswe 961 dkqkcdsgkp vlrthlyihh aidlateevs qmqlcsqaae elitricdaa tihclleqel 1021 ahavnacsha lnkanprcpe sltrdtatei ainvkalyne tesllvgrvp lqlespheer 1081 vsnalhsvev elqklteipw lyyilhpned eeppmdctkr nnrstvfriv pkfkkekvqk 1141 qktssqpvqk wgteevaawl dllnlgeykd ifirhdirga ellhlerrdl kdlgipkvgh 1201 vkrilqgike lgrstpqsev
```

Diacylglycerol kinase eta, isoform 3, NP_001191434.1

(SEQ ID NO: 67)

```
   1 mlcaenrkem edwisslksv qtrepyevaq fnvehfsgmh nwyacsharp tfcnvcresl 61 sgvtshglsc evckfkahkr cavratnnck wttlasigkd iiededgvam phqwlegnlp 121 vsakcavcdk tcgsvlrlqd wkclwcktmv htackdlyhp icplgqckvs iippialnst 181 dsdgfcratf sfcvspllvf vnsksgdnqg vkflrrfkql lnpaqvfdlm nggphlglrl 241 fqkfdnfril vcggdgsvgw vlseidklnl nkqcqlgvlp lgtgndlary lgwggsyddd 301 tqlpqilekl erastkmldr wsimtyelkl ppkasllpgp peaseefymt iyedsvathl 361 tkilnsdeha vvissaktlc etvkdfvakv ektydktlen avvadavask csvlnekleq 421 llqalhtdsq aapvlpglsp liveedaves sseeslgesk eqlgddvtkp ssqkavkpre 481 imlranslkk avrqvieeag kvmddptvhp cepanqssdy dstetdeske eakddgakes 541 itvktaprsp darasyghsq tdsvpgpava askenlpvln triicpglra glaasiagss 601 iinkmllani dpfgatpfid pdldsvdgys ekcvmnnyfg igldakisle fnnkreehpe 661 kcrsrtknlm wygvlgtrel lqrsyknleq rvqlecdgqy iplpslqgia vinipsyagg 721 tnfwggtked difaapsfdd kilevvaifd smqmavsrvi klqhhriaqc rtvkitifgd 781 egvpvqvdge awvqppgiik ivhknraqml trdrafestl kswedkqkcd sgkpvlrthl 841 yihhaidlat eevsqmqlcs qaaeelitri cdaatihcll eqelahavna cshalnkanp 901 rcpesltrdt ateiainvka lynetesllv grvplqlesp heervsnalh svevelqklt
```

```
 961 eipwlyyilh pnedeeppmd ctkrnnrstv frivpkfkke kvqkqktssq pvqkwgteev 1021 aawldllnlg eykdifirhd irgaellhle rrdlkntvge krdtkengkh mdlgipkvgh 1081 vkrilqgike lgrstpqsev
```

Diacylglycerol kinase eta, isoform 4, NP_001191435.1
(SEQ ID NO: 68)

```
   1 mlcaenrkem edwisslksv qtrepyevaq fnvehfsgmh nwyacsharp tfcnvcresl 61 sgvtshglsc evckfkahkr cavratnnck wttlasigkd iiededgvam phqwlegnlp 121 vsakcavcdk tcgsvlrlqd wkclwcktmv htackdlyhp icplgqckvs iippialnst 181 dsdgfcratf sfcvspllvf vnsksgdnqg vkflrrfkql lnpaqvfdlm nggphlglrl 241 fqkfdnfril vcggdgsvgw vlseidklnl nkqcqlgvlp lgtgndlarv lgwggsyddd 301 tqlpqilekl erastkmldr wsimtyelkl ppkasllpgp peaseefymt iyedsvathl 361 tkilnsdeha vvissaktlc etvkdfvakv ektydktlen avvadavask csvlnekleq 421 llqalhtdsq aapvlpglsp liveedaves sseeslgesk eqlgddvtkp ssqkavkpre 481 imlranslkk avrqvieeag kvmddptvhp cepanqssdy dstetdeske eakddgakes 541 itvktaprsp darasyghsq tdsvpgpava askenlpvln triicpglra glaasiagss 601 iinkmllani dpfgatpfid pdldsvdgys ekcvmnnyfg igldakisle fnnkreehpe 661 kcrsrtknlm wygvlgtrel lqrsyknleq rvqlecdgqy iplpslqgia vinipsyagg 721 tnfwggtked difaapsfdd kilevvaifd smqmavsrvi klqhhriaqc rtvkitifgd 781 egvpvqvdge awvqppgiik ivhknraqml trdrafestl kswedkqkcd sgkpvlrthl 841 yihhaidlat eevsqmqlcs qaaeelitri cdaatihcll eqelahavna cshalnkanp 901 rcpesltrdt ateiainvka lynetesllv grvplqlesp heervsnalh svevelqklt 961 eipwlyyilh pnedeeppmd ctkrnnrstv frivpkfkke kvqkqktssq pvqkwgteev 1021 aawldllnlg eykdifirhd irgaellhle rrdlkdlgip kvghvkrilq gikelgrstp 1081 qsev
```

Diacylglycerol kinase eta, isoform 5, NP_001284358.1
(SEQ ID NO: 69)

```
   1 mwnisqgctt gtpaptpdpp svtcaervfl esppmacpak vhtackdlyh picplgqckv 61 siippialns tdsdgfcrat fsfcvspllv fvnsksgdnq gvkflrrfkq llnpaqvfdl 121 mnggphlglr lfqkfdnfri lvcggdgsvg wvlseidkln lnkqcqlgvl plgtgndlar 181 vlgwggsydd dtqlpqilek lerastkmld rwsimtyelk lppkasllpg ppeaseefym 241 tiyedsvath ltkilnsdeh avvissaktl cetvkdfvak vektydktle navvadavas 301 kcsvinekle qllqalhtds qaapvlpgls pliveedave ssseeslges keqlgddvtk 361 pssqkavkpr eimlranslk kavrqvieea gkvmddptvh pcepanqssd ydstetdesk 421 eeakddgake sitvktaprs pdarasyghs qtdsvpgpav aaskenlpvl ntriicpglr 481 aglaasiags siinkmllan idpfgatpfi dpdldsvdgy sekcvmnnyf gigldakisl 541 efnnkreehp ekcrsrtknl mwygvlgtre llqrsyknle qrvqlecdgq yiplpslqgi 601 avlnipsyag gtnfwggtke ddifaapsfd dkilevvaif dsmqmavsry iklqhhriaq 661 crtvkitifg degvpvqvdg eawvqppgii kivhknraqm ltrdrafest lkswedkqkc 721 dsgkpvlrth lyihhaidla teevsqmqlc sqaaeelitr icdaatihcl leqelahavn 781 acshalnkan prcpesltrd tateiainvk alynetesll vgrvplqles pheervsnal 841 hsvevelqkl teipwlyyil hpnedeeppm dctkrnnrst vfrivpkfkk ekvqkqktss 901 qpgsgdtesg sceanspgn
```

-continued

Eukaryotic translation elongation factor 2, NP_001952.1
(SEQ ID NO: 70)

```
  1 mvnftvdqir aimdkkanir nmsviahvdh gkstltdslv ckagiiasar agetrftdtr
 61 kdegerciti kstaislfye lsendlnfik qskdgagfli nlidspghvd fssevtaalr
121 vtdgalvvvd cvsgvcvqte tvlrqaiaer ikpvlmmnkm drallelqle peelyqtfqr
181 ivenvnviis tygegesgpm gnimidpvlg tvgfgsglhg waftlkqfae myvakfaakg
241 egqlgpaera kkvedmmkkl wgdryfdpan gkfsksatsp egkklprtfc qlildpifkv
301 fdaimnfkke etakliekld ikldsedkdk egkpllkavm rrwlpagdal lqmitihlps
361 pvtaqkyrce llyegppdde aamgikscdp kgplmmyisk mvptsdkgrf yafgrvfsgl
421 vstglkvrim gpnytpgkke dlylkpiqrt ilmmgryvep iedvpcgniv glvgvdqflv
481 ktgtittfeh ahnmrvmkfs vspvvrvave aknpadlpkl veglkrlaks dpmvqciiee
541 sgehiiagag elhleiclkd leedhacipi kksdpvvsyr etvseesnvl clskspnkhn
601 rlymkarpfp dglaedidkg evsarqelkq rarylaekye wdvaearkiw cfgpdgtgpn
661 iltditkgvq ylneikdsvv agfqwatkeg alceenmrgv rfdvhdvtlh adaihrgggq
721 iiptarrcly asvltaqprl mepiylveiq cpeqvvggiy gvinrkrghv feesqvagtp
781 mfvvkaylpv nesfgftadl rsntggqafp qcvfdhwqil pgdpfdnssr psqvvaetrk
841 rkglkegipa ldnfldkl
```

Eukaryotic translation initiation factor 5A, isoform A,
NP_001137232.1
(SEQ ID NO: 71)

```
  1 mcgtggtdsk trrpphrasf lkrleskplk maddldfetg dagasatfpm qcsalrkngf
 61 vvlkgrpcki vemstsktgk hghakvhlvg idiftgkkye dicpsthnmd vpnikrndfq
121 ligiqdgyls llqdsgevre dlrlpegdlg keieqkydcg eeilitvlsa mteeaavaik
181 amak
```

Eukaryotic translation initiation factor 5A, isoform B,
NP_001137233.1, NP_001137234.1, NP_001961.1
(SEQ ID NO: 72)

```
  1 maddldfetg dagasatfpm qcsalrkngf vvlkgrpcki vemstsktgk hghakvhlvg
 61 idiftgkkye dicpsthnmd vpnikrndfq ligiqdgyls llqdsgevre dlrlpegdlg
121 keieqkydcg eeilitvlsa mteeaavaik amak
```

Fibronectin 1, isoform 1 precursor, NP_997647.1
(SEQ ID NO: 73)

```
  1 mlrgpgpgll llavqclgta vpstgasksk rqaqqmvqpq spvaysgskp gcydngkhyq
 61 inqqwertyl gnalvctcyg gsrgfncesk peaeetcfdk ytgntyrvgd tyerpkdsmi
121 wdctcigagr grisctianr cheggqsyki gdtwrrphet ggymlecvcl gngkgewtck
181 piaekcfdha agtsyvvget wekpyqgwmm vdctclgegs gritctsrnr cndqdtrtsy
241 rigdtwskkd nrgnllqcic tgngrgewkc erhtsvqtts sgsgpftdvr aavyqpqphp
301 qpppyghcvt dsgvvysvgm qwlktqgnkq mlctclgngv scqetavtqt yggnsngepc
361 vlpftyngrt fysctteqrq dghlwcstts nyeqdqkysf ctdhtvlvqt rggnsngalc
421 hfpflynnhn ytdctsegrr dnmkwcgttq nydadqkfgf cpmaaheeic ttnegvmyri
481 gdqwdkqhdm ghmmrctcvg ngrgewtcia ysqlrdqciv dditynvndt fhkrheeghm
541 lnctcfgqgr grwkcdpvdq cqdsetgtfy qigdswekyv hgvryqcycy grgigewhcq
601 plqtypsssg pvevfitetp sqpnshpiqw napqpshisk yilrwrpkns vgrwkeatip
661 ghlnsytikg lkpgvvyegq lisiqqyghq evtrfdfttt ststpvtsnt vtgettpfsp
721 lvatsesvte itassfvvsw vsasdtvsgf rveyelseeg depqyldlps tatsvnipdl
781 lpgrkyivnv yqisedgeqs lilstsqtta pdappdptvd qvddtsivvr wsrpqapitg
```

-continued

```
 841  yrivyspsve gsstelnlpe tansvtlsdl qpgvqyniti yaveenqest pvviqqettg
 901  tprsdtvpsp rdlqfvevtd vkvtimwtpp esavtgyrvd vipvnlpgeh gqrlpisrnt
 961  faevtglspg vtyyfkvfav shgreskplt aqqttkldap tnlqfvnetd stvlvrwtpp
1021  raqitgyrlt vgltrrgqpr qynvgpsysk yplrnlqpas eytvslvaik gnqespkatg
1081  vfttlqpgss ippyntevte ttivitwtpa prigfklgvr psqggeapre vtsdsgsivv
1141  sgltpgveyv ytiqvlrdgq erdapivnkv vtplspptnl hleanpdtgv ltvswerstt
1201  pditgyritt tptngqqgns leevvhadqs sctfdnlspg leynvsvytv kddkesvpis
1261  dtiipevpql tdlsfvditd ssiglrwtpl nsstiigyri tvvaagegip ifedfvdssv
1321  gyytvtglep gidydisvit linggesapt tltqqtavpp ptdlrftnig pdtmrvtwap
1381  ppsidltnfl vryspvknee dvaelsisps dnavvltnll pgteyvvsys svyeqhestp
1441  lrgrqktgld sptgidfsdi tansftvhwi apratitgyr irhhpehfsg rpredrvphs
1501  rnsitltnit pgteyvvsiv alngreespl ligqqstvsd vprdlevvaa tptslliswd
1561  apavtvryyr itygetggns pvqeftvpgs kstatisglk pgvdytitvy avtgrgdspa
1621  sskpisinyr teidkpsqmq vtdvgdnsis vkwlpssspv tgyrvtttpk ngpgptktkt
1681  agpdqtemti eglqptveyv vsvyaqnpsg esqplvqtav tnidrpkgla ftdvdvdsik
1741  iawespqgqv sryrvtyssp edgihelfpa pdgeedtael qglrpgseyt vsvvalhddm
1801  esqpligtqs taipaptdlk ftqvtptsls aqwtppnvql tgyrvrvtpk ektgpmkein
1861  lapdsssvvv sglmvatkye vsvyalkdtl tsrpaqgvvt tlenvspprr arvtdatett
1921  itiswrtkte titgfqvdav pangqtpiqr tikpdvrsyt itglqpgtdy kiylytlndn
1981  arsspvvida staidapsnl rflattpnsl lvswqpprar itgyiikyek pgspprevvp
2041  rprpgvteat itglepgtey tiyvialknn qksepligrk ktdelpqlvt lphpnlhgpe
2101  ildvpstvqk tpfvthpgyd tgngiqlpgt sgqgpsvggq mifeehgfrr ttppttatpi
2161  rhrprpyppn vgeeiqighi predvdyhly phgpglnpna stgqealsqt tiswapfqdt
2221  seyiischpv gtdeeplqfr vpgtstsatl tgltrgatyn iivealkdqq rhkvreevvt
2281  vgnsvnegln qptddscfdp ytvshyavgd ewermsesgf kllcqclgfg sghfrcdssr
2341  wchdngvnyk igekwdrqge ngqmmsctcl gngkgefkcd pheatcyddg ktyhvgeqwq
2401  keylgaicsc tcfggqrgwr cdncrrpgge pspegttgqs ynqysqryhq rtntnvncpi
2461  ecfmpldvqa dredsre
```

Fibronectin 1, isoform 3 precursor, NP_002017.1

(SEQ ID NO: 74)

```
   1  mlrgpgpgll llavqclgta vpstgasksk rqaqqmvqpq spvaysgskp gcydngkhyq
  61  inqqwertyl gnalvctcyg gsrgfncesk peaeetcfdk ytgntyrvgd tyerpkdsmi
 121  wdctcigagr grisctianr cheggqsyki gdtwrrphet ggymlecvcl gngkgewtck
 181  piaekcfdha agtsyvvget wekpyqgwmm vdctclgegs gritctsrnr cndqdtrtsy
 241  rigdtwskkd nrgnllqcic tgngrgewkc erhtsvqtts sgsgpftdvr aavyqpqphp
 301  qpppyghcvt dsgvvysvgm qwlktqgnkq mlctclgngv scqetavtqt yggnsngepc
 361  vlpftyngrt fysccttegrq dghlwcstts nyeqdqkysf ctdhtvlvqt rggnsngalc
 421  hfpflynnhn ytdctsegrr dnmkwcgttq nydadqkfgf cpmaaheeic ttnegvmyri
 481  gdqwdkqhdm ghmmrctcvg ngrgewtcia ysqlrdqciv dditynvndt fhkrheeghm
 541  lnctcfgqgr grwkcdpvdq cqdsetgtfy qigdswekyv hgvryqcycy grgigewhcq
 601  plqtypsssg pvevfitetp sqpnshpiqw napqpshisk yilrwrpkns vgrwkeatip
```

-continued

```
 661 ghlnsytikg lkpgvvyegq lisiqqyghq evtrfdfttt ststpvtsnt vtgettpfsp
 721 lvatsesvte itassfvvsw vsasdtvsgf rveyelseeg depqyldlps tatsvnipdl
 781 lpgrkyivnv yqisedgeqs lilstsqtta pdappdptvd qvddtsivvr wsrpqapitg
 841 yrivyspsve gsstelnlpe tansvtlsdl qpgvqyniti yaveenqest pvviqqettg
 901 tprsdtvpsp rdlqfvevtd vkvtimwtpp esavtgyrvd vipvnlpgeh gqrlpisrnt
 961 faevtglspg vtyyfkvfav shgreskplt aqqttkldap tnlqfvnetd stvlvrwtpp
1021 raqitgyrlt vgltrrgqpr qynvgpsvsk yplrnlqpas eytvslvaik gnqespkatg
1081 vfttlqpgss ippyntevte ttivitwtpa prigfklgvr psqggeapre vtsdsgsivv
1141 sgltpgveyv ytiqvlrdgq erdapivnkv vtplspptnl hleanpdtgv ltvswerstt
1201 pditgyritt tptngqqgns leevvhadqs sctfdnlspg leynvsvytv kddkesvpis
1261 dtiipavppp tdlrftnigp dtmrvtwapp psidltnflv ryspvkneed vaelsispsd
1321 navvltnllp gteyvvsyss vyeqhestpl rgrqktglds ptgidfsdit ansftvhwia
1381 pratitgyri rhhpehfsgr predrvphsr nsitltnitp gteyvvsiva lngreespll
1441 igqqstvsdv prdlevvaat ptslliswda pavtvryyri tygetggnsp vqeftvpgsk
1501 statisglkp gvdytitvya vtgrgdspas skpisinyrt eidkpsqmqv tdvqdnsisv
1561 kwlpssspvt gyrvtttpkn gpgptktkta gpdqtemtie glqptveyvv svyagnpsge
1621 sqplvqtavt nidrpkglaf tdvdvdsiki awespqgqvs ryrvtysspe dgihelfpap
1681 dgeedtaelq glrpgseytv svvalhddme sqpligtqst aipaptdlkf tqvtptslsa
1741 qwtppnvqlt gyrvrvtpke ktgpmkeinl apdsssvvvs glmvatkyev svyalkdtlt
1801 srpaqgvvtt lenvspprra rvtdatetti tiswrtktet itgfqvdavp angqtpiqrt
1861 ikpdvrsyti tglqpgtdyk iylytlndna rsspvvidas taidapsnlr flattpnsll
1921 vswqpprari tgyiikyekp gspprevvpr prpgvteati tglepgteyt iyvialknnq
1981 ksepligrkk tdelpqlvtl phpnlhgpei ldvpstvqkt pfvthpgydt gngiqlpgts
2041 gqqpsvgqqm ifeehgfrrt tpptatpir hrprpyppnv gqealsqtti swapfqdtse
2101 yiischpvgt deeplqfrvp gtststatltg ltrgatynii vealkdqqrh kvreevvtvg
2161 nsvneglnqp tddscfdpyt vshyavgdew ermsesgfkl lcgclgfgsg hfrcdssrwc
2221 hdngvnykig ekwdrqgeng qmmsctclgn gkgefkcdph eatcyddgkt yhvgeqwqke
2281 ylgaicsctc fggqrgwrcd ncrrpggeps pegttgqsyn gysqryhqrt ntnvncpiec
2341 fmpldvqadr edsre
```

Fibronectin 1, isoform 4 precursor, NP_997643.1

(SEQ ID NO: 75)

```
   1 mlrgpgpgll llavqclgta vpstgasksk rqaqqmvqpq spvavsqskp gcydngkhyq
  61 inqqwertyl gnalvctcyg gsrgfncesk peaeetcfdk ytgntyrvgd tyerpkdsmi
 121 wdctcigagr grisctianr cheggqsyki gdtwrrphet ggymlecvcl gngkgewtck
 181 piaekcfdha agtsyvvget wekpyqgwmm vdctclgegs gritctsrnr cndqdtrtsy
 241 rigdtwskkd nrgnllqcic tgngrgewkc erhtsvqtts sgsgpftdvr aavyqpqphp
 301 qpppyghcvt dsgvvysvgm qwlktqgnkq mlctclngv scqetavtqt yggnsngepc
 361 vlpftyngrt fyscttegrq dghlwcstts nyeqdqkysf ctdhtvlvqt rggnsngalc
 421 hfpflynnhn ytdctsegrr dnmkwcgttq nydadqkfgf cpmaaheeic ttnegvmyri
 481 gdqwdkqhdm ghmmrctcvg ngrgewtcia ysqlrdqciv dditynvndt fhkrheeghm
 541 lnctcfgqgr grwkcdpvdq cqdsetgtfy qigdswekyv hgvryqcycy grgigewhcq
 601 plqtypsssg pvevfitetp sqpnshpiqw napqpshisk yilrwrpkns vgrwkeatip
```

-continued

```
 661 ghlnsytikg lkpgvvyegq lisiqqyghq evtrfdfttt ststpvtsnt vtgettpfsp
 721 lvatsesvte itassfvvsw vsasdtvsgf rveyelseeg depqyldlps tatsvnipdl
 781 lpgrkyivnv yqisedgeqs lilstsqtta pdappdptvd qvddtsivvr wsrpqapitg
 841 yrivyspsve gsstelnlpe tansvtlsdl qpgvqyniti yaveengest pvviqqettg
 901 tprsdtvpsp rdlqfvevtd vkvtimwtpp esavtgyrvd vipvnlpgeh gqrlpisrnt
 961 faevtglspg vtyyfkvfav shgreskplt aqqttkldap tnlqfvnetd stvlvrwtpp
1021 raqitgyrlt vgltrrgqpr qynvgpsysk yplrnlqpas eytvslvaik gnqespkatg
1081 vfttlqpgss ippyntevte ttivitwtpa prigfklgvr psqggeapre vtsdsgsivv
1141 sgltpgveyv ytiqvlrdgq erdapivnkv vtplspptnl hleanpdtgv ltvswerstt
1201 pditgyritt tptngqqgns leevvhadqs sctfdnlspg leynvsvytv kddkesvpis
1261 dtiipavppp tdlrftnigp dtmrvtwapp psidltnflv ryspvkneed vaelsispsd
1321 navvltnllp gteyvvsyss vyeqhestpl rgrqktglds ptgidfsdit ansftvhwia
1381 pratitgyri rhhpehfsgr predrvphsr nsitltnitp gteyvvsiva lngreespll
1441 igqqstvsdv prdlevvaat ptslliswda pavtvryyri tygetggnsp vqeftvpgsk
1501 statisglkp gvdytitvya vtgrgdspas skpisinyrt eidkpsqmqv tdvqdnsisv
1561 kwlpssspvt gyrvtttpkn gpgptktkta gpdqtemtie glqptveyvv svyagnpsge
1621 sqplvqtavt nidrpkglaf tdvdvdsiki awespqgqvs ryrvtysspe dgihelfpap
1681 dgeedtaelq glrpgseytv svvalhddme sqpligtqst aipaptdlkf tqvtptslsa
1741 qwtppnvqlt gyrvrvtpke ktgpmkeinl apdsssvvvs glmvatkyev svyalkdtlt
1801 srpaqgvvtt lenvspprra rvtdatetti tiswrtktet itgfqvdavp angqtpiqrt
1861 ikpdvrsyti tglqpgtdyk iylytlndna rsspvvidas taidapsnlr flattpnsll
1921 vswqpprari tgyiikyekp gspprevvpr prpgvteati tglepgteyt iyvialknnq
1981 ksepligrkk tvqktpfvth pgydtgngiq lpgtsgqqps vgqqmifeeh gfrrttpptt
2041 atpirhrprp yppnvgqeal sqttiswapf qdtseyiisc hpvgtdeepl qfrvpgtsts
2101 atltgltrga tyniivealk dqqrhkvree vvtvgnsvne glnqptddsc fdpytvshya
2161 vgdewermse sgfkllcqcl gfgsghfrcd ssrwchdngv nykigekwdr ggengqmmsc
2221 tclgngkgef kcdpheatcy ddgktyhvge qwqkeylgai csctcfggqr gwrcdncrrp
2281 ggepspegtt gqsynqysqr yhqrtntnvn cpiecfmpld vqadredsre
```

Fibronectin 1, isoform 5 precursor, NP_997641.1

(SEQ ID NO: 76)

```
   1 mlrgpgpgll llavqclgta vpstgasksk rqaqqmvqpq spvaysqskp gcydngkhyq
  61 inqqwertyl gnalvctcyg gsrgfncesk peaeetcfdk ytgntyrvgd tyerpkdsmi
 121 wdctcigagr grisctianr cheggqsyki gdtwrrphet ggymlecvcl gngkgewtck
 181 piaekcfdha agtsyvvget wekpyqgwmm vdctclgegs gritctsrnr cndqdtrtsy
 241 rigdtwskkd nrgnllqcic tgngrgewkc erhtsvqtts sgsgpftdvr aavyqpqphp
 301 qpppyghcvt dsgvvysvgm qwlktqgnkq mlctclgngv scqetavtqt yggnsngepc
 361 vlpftyngrt fysctttegrq dghlwcstts nyeqdqkysf ctdhtvlvqt rggnsngalc
 421 hfpflynnhn ytdctsegrr dnmkwcgttq nydadqkfgf cpmaaheeic ttnegvmyri
 481 gdqwdkqhdm ghmmrctcvg ngrgewtcia ysqlrdqciv dditynvndt fhkrheeghm
 541 lnctcfgqgr grwkcdpvdq cqdsetgtfy qigdswekyv hgvryqcycy grgigewhcq
 601 plqtypsssg pvevfitetp sqpnshpiqw napqpshisk yilrwrpkns vgrwkeatip
```

-continued

```
 661 ghlnsytikg lkpgvvyegq lisiqqyghq evtrfdfttt ststpvtsnt vtgettpfsp 721 lvatsesvte itassfvvsw vsasdtvsgf rveyelseeg depqyldlps tatsvnipdl 781 lpgrkyivnv ygisedgeqs lilstsqtta pdappdptvd qvddtsivvr wsrpqapitg 841 yrivyspsve gsstelnlpe tansvtlsdl qpgvqyniti yaveenqest pvviqqettg 901 tprsdtvpsp rdlqfvevtd vkvtimwtpp esavtgyrvd vipvnlpgeh gqrlpisrnt 961 faevtglspg vtyyfkvfav shgreskplt aqqttkldap tnlqfvnetd stvlvrwtpp 1021 raqitgyrlt vgltrrgqpr qynvgpsysk yplrnlqpas eytvslvaik gnqespkatg 1081 vfttlqpgss ippyntevte ttivitwtpa prigfklgvr psqggeapre vtsdsgsivv 1141 sgltpgveyv ytiqvlrdgq erdapivnkv vtplspptnl hleanpdtgv ltvswerstt 1201 pditgyritt tptngqqgns leevvhadqs sctfdnlspg leynvsvytv kddkesvpis 1261 dtiipavppp tdlrftnigp dtmrvtwapp psidltnflv ryspvkneed vaelsispsd 1321 navvltnllp gteyvvsyss vyeghestpl rgrqktglds ptgidfsdit ansftvhwia 1381 pratitgyri rhhpehfsgr predrvphsr nsitltnitp gteyvvsiva lngreespll 1441 igqqstvsdv prdlevvaat ptslliswda pavtvryyri tygetggnsp vqeftvpgsk 1501 statisglkp gvdytitvya vtgrgdspas skpisinyrt eidkpsqmqv tdvgdnsisv 1561 kwlpssspvt gyrvtttpkn gpgptktkta gpdqtemtie glqptveyvv svyagnpsge 1621 sqplvqtavt tipaptdlkf tqvtptslsa qwtppnvqlt gyrvrvtpke ktgpmkeinl 1681 apdsssvvvs glmvatkyev svyalkdtlt srpaqgvvtt lenvspprra rvtdatetti 1741 tiswrtktet itgfqvdavp angqtpiqrt ikpdvrsyti tglqpgtdyk iylytlndna 1801 rsspvvidas taidapsnlr flattpnsll vswqpprari tgyiikyekp gspprevvpr 1861 prpgvteati tglepgteyt iyvialknnq ksepligrkk tdelpqlvtl phpnlhgpei 1921 ldvpstvqkt pfvthpgydt gngiqlpgts gqpsvgqqm ifeehgfrrt tppttatpir 1981 hrprpyppnv geeigighip redvdyhlyp hgpglnpnas tggealsqtt iswapfqdts 2041 eyiischpvg tdeeplqfry pgtstsatlt gltrgatyni ivealkdqqr hkvreevvtv 2101 gnsvneglnq ptddscfdpy tvshyavgde wermsesgfk llcqclgfgs ghfrcdssrw 2161 chdngvnyki gekwdrggen gqmmsctclg ngkgefkcdp heatcyddgk tyhvgeqwqk 2221 eylgaicsct cfggqrgwrc dncrrpggep spegttgqsy nqysqryhqr tntnvncpie 2281 cfmpldvqad redsre
```

Fibronectin 1, isoform 6 precursor, NP_997639.1

(SEQ ID NO: 77)

```
   1 mlrgpgpgll llavqclgta vpstgasksk rqaqqmvqpq spvaysgskp gcydngkhyq 61 inqqwertyl gnalvctcyg gsrgfncesk peaeetcfdk ytgntyrvgd tyerpkdsmi 121 wdctcigagr grisctianr cheggqsyki gdtwrrphet ggymlecvcl gngkgewtck 181 piaekcfdha agtsyvvget wekpyqgwmm vdctclgegs gritctsrnr cndqdtrtsy 241 rigdtwskkd nrgnllqcic tgngrgewkc erhtsvqtts sgsgpftdvr aavyqpqphp 301 qpppyghcvt dsgvvysvgm qwlktqgnkq mlctclgngv scqetavtqt yggnsngepc 361 vlpftyngrt fysctteqrq dghlwcstts nyeqdqkysf ctdhtvlvqt rggnsngalc 421 hfpflynnhn ytdctsegrr dnmkwcgttq nydadqkfgf cpmaaheeic ttnegvmyri 481 gdqwdkqhdm ghmmrctcvg ngrgewtcia ysqlrdqciv dditynvndt fhkrheeghm 541 lnctcfgqgr grwkcdpvdq cqdsetgtfy gigdswekyv hgvryqcycy grgigewhcq 601 plqtypsssg pvevfitetp sqpnshpiqw napqpshisk yilrwrpkns vgrwkeatip 661 ghlnsytikg lkpgvvyegq lisiqqyghq evtrfdfttt ststpvtsnt vtgettpfsp
```

-continued

```
 721 lvatsesvte itassfvvsw vsasdtvsgf rveyelseeg depqyldlps tatsvnipdl
 781 lpgrkyivnv ygisedgeqs lilstsqtta pdappdptvd qvddtsivvr wsrpqapitg
 841 yrivyspsve gsstelnlpe tansvtlsdl qpgvqyniti yaveengest pvviqqettg
 901 tprsdtvpsp rdlqfvevtd vkvtimwtpp esavtgyrvd vipvnlpgeh gqrlpisrnt
 961 faevtglspg vtyyfkvfav shgreskplt aqqttkldap tnlqfvnetd stvlvrwtpp
1021 raqitgyrlt vgltrrgqpr qynvgpsysk yplrnlqpas eytvslvaik gnqespkatg
1081 vfttlqpgss ippyntevte ttivitwtpa prigfklgvr psqggeapre vtsdsgsivv
1141 sgltpgveyv ytiqvlrdgq erdapivnkv vtplspptnl hleanpdtgv ltvswerstt
1201 pditgyritt tptngqqgns leevvhadqs sctfdnlspg leynvsvytv kddkesvpis
1261 dtiipavppp tdlrftnigp dtmrvtwapp psidltnflv ryspvkneed vaelsispsd
1321 navvltnllp gteyvvsyss vyeghestpl rgrqktglds ptgidfsdit ansftvhwia
1381 pratitgyri rhhpehfsgr predrvphsr nsitltnitp gteyvvsiva lngreespll
1441 igqqstvsdv prdlevvaat ptslliswda pavtvryyri tygetggnsp vqeftvpgsk
1501 statisglkp gvdytitvya vtgrgdspas skpisinyrt eidkpsqmqv tdvgdnsisv
1561 kwlpssspvt gyrvtttpkn gpgptktkta gpdqtemtie glqptveyvv svyagnpsge
1621 sqplvqtavt tipaptdlkf tqvtptslsa qwtppnvqlt gyrvrvtpke ktgpmkeinl
1681 apdsssvvvs glmvatkyev svyalkdtlt srpaqgvvtt lenvspprra rvtdatetti
1741 tiswrtktet itgfqvdavp angqtpiqrt ikpdvrsyti tglqpgtdyk iylytlndna
1801 rsspvvidas taidapsnlr flattpnsll vswqpprari tgyiikyekp gspprevvpr
1861 prpgvteati tglepgteyt iyvialknnq ksepligrkk tggealsqtt iswapfqdts
1921 eyiischpvg tdeeplqfry pgtstsatlt gltrgatyni ivealkdqqr hkvreevvtv
1981 gnsvneglnq ptddscfdpy tvshyavgde wermsesgfk llcqclgfgs ghfrcdssrw
2041 chdngvnyki gekwdrggen gqmmsctclg ngkgefkcdp heatcyddgk tyhvgeqwqk
2101 eylgaicsct cfggqrgwrc dncrrpggep spegttgqsy nqysqryhqr tntnvncpie
2161 cfmpldvqad redsre
```

Fibronectin 1, isoform 7 precursor, NP_473375.2

(SEQ ID NO: 78)

```
   1 mlrgpgpgll llavqclgta vpstgasksk rqaqqmvqpq spvaysgskp gcydngkhyq
  61 inqqwertyl gnalvctcyg gsrgfncesk peaeetcfdk ytgntyrvgd tyerpkdsmi
 121 wdctcigagr grisctianr cheggqsyki gdtwrrphet ggymlecvcl gngkgewtck
 181 piaekcfdha agtsyvvget wekpyqgwmm vdctclgegs gritctsrnr cndqdtrtsy
 241 rigdtwskkd nrgnllqcic tgngrgewkc erhtsvqtts sgsgpftdvr aavyqpqphp
 301 qpppyghcvt dsgvvysvgm qwlktqgnkq mlctclngv scqetavtqt yggnsngepc
 361 vlpftyngrt fysccttegrq dghlwcstts nyeqdqkysf ctdhtvlvqt rggnsngalc
 421 hfpflynnhn ytdctsegrr dnmkwcgttq nydadqkfgf cpmaaheeic ttnegvmyri
 481 gdqwdkqhdm ghmmrctcvg ngrgewtcia ysqlrdqciv dditynvndt fhkrheeghm
 541 lnctcfgqgr grwkcdpvdq cqdsetgtfy gigdswekyv hgvryqcycy grgigewhcq
 601 plqtypsssg pvevfitetp sqpnshpiqw napqpshisk yilrwrpvsi pprnlgy
```

Fibronectin 1, isoform 8 precursor, NP_001293058.1

(SEQ ID NO: 79)

```
   1 mlrgpgpgll llavqclgta vpstgasksk rqaqqmvqpq spvaysqskp gcydngkhyq
  61 inqqwertyl gnalvctcyg gsrgfncesk peaeetcfdk ytgntyrvgd tyerpkdsmi
```

-continued

```
 121 wdctcigagr grisctianr cheggqsyki gdtwrrphet ggymlecvcl gngkgewtck
 181 piaekcfdha agtsyvvget wekpyqgwmm vdctclgegs gritctsrnr cndqdtrtsy
 241 rigdtwskkd nrgnllqcic tgngrgewkc erhtsvqtts sgsgpftdvr aavyqpqphp
 301 qpppyghcvt dsgvvysvgm qwlktqgnkq mlctclgngv scqetavtqt yggnsngepc
 361 vlpftyngrt fyscttegrq dghlwcstts nyeqdqkysf ctdhtvlvqt rggnsngalc
 421 hfpflynnhn ytdctsegrr dnmkwcgttq nydadqkfgf cpmaaheeic ttnegvmyri
 481 gdqwdkqhdm ghmmrctcvg ngrgewtcia ysqlrdqciv dditynvndt fhkrheeghm
 541 lnctcfgqgr grwkcdpvdq cqdsetgtfy qigdswekyv hgvryqcycy grgigewhcq
 601 plqtypsssg pvevfitetp sqpnshpiqw napqpshisk yilrwrpkns vgrwkeatip
 661 ghlnsytikg lkpgvvyegq lisiqqyghq evtrfdfttt ststpvtsnt vtgettpfsp
 721 lvatsesvte itassfvvsw vsasdtvsgf rveyelseeg depqyldlps tatsvnipdl
 781 lpgrkyivnv yqisedgeqs lilstsqtta pdappdptvd qvddtsivvr wsrpqapitg
 841 yrivyspsve gsstelnlpe tansvtlsdl qpgvqyniti yaveengest pvviqqettg
 901 tprsdtvpsp rdlqfvevtd vkvtimwtpp esavtgyrvd vipvnlpgeh gqrlpisrnt
 961 faevtglspg vtyyfkvfav shgreskplt aqqttkldap tnlqfvnetd stvlvrwtpp
1021 raqitgyrlt vgltrrgqpr qynvgpsysk yplrnlqpas eytvslvaik gnqespkatg
1081 vfttlqpgss ippyntevte ttivitwtpa prigfklgvr psqggeapre vtsdsgsivv
1141 sgltpgveyv ytiqvlrdgq erdapivnkv vtplspptnl hleanpdtgv ltvswerstt
1201 pditgyritt tptngqqgns leevvhadqs sctfdnlspg leynvsvytv kddkesvpis
1261 dtiipevpql tdlsfvditd ssiglrwtpl nsstiigyri tvvaagegip ifedfvdssv
1321 gyytvtglep gidydisvit linggesapt tltqqtavpp ptdlrftnig pdtmrvtwap
1381 ppsidltnfl vryspvknee dvaelsisps dnavvltnll pgteyvvsys svyeghestp
1441 lrgrqktgld sptgidfsdi tansftvhwi apratitgyr irhhpehfsg rpredrvphs
1501 rnsitltnit pgteyvvsiv alngreespl ligqqstvsd vprdlevvaa tptsllisd
1561 apavtvryyr itygetggns pvqeftvpgs kstatisglk pgvdytitvy avtgrgdspa
1621 sskpisinyr teidkpsqmq vtdvgdnsis vkwlpssspv tgyrvtttpk ngpgptktkt
1681 agpdqtemti eglqptveyv vsvyagnpsg esqplvqtav tnidrpkgla ftdvdvdsik
1741 iawespqgqv sryrvtyssp edgihelfpa pdgeedtael qglrpgseyt vsvvalhddm
1801 esqpligtqs taipaptdlk ftqvtptsls aqwtppnvql tgyrvrvtpk ektgpmkein
1861 lapdsssvvv sglmvatkye vsvyalkdtl tsrpaqgvvt tlenvspprr arvtdatett
1921 itiswrtkte titgfqvdav pangqtpiqr tikpdvrsyt itglqpgtdy kiylytlndn
1981 arsspvvida staidapsnl rflattpnsl lvswqpprar itgyiikyek pgspprevvp
2041 rprpgvteat itglepgtey tiyvialknn qksepligrk ktdelpqlvt lphpnlhgpe
2101 ildvpstvqk tpfvthpgyd tgngiqlpgt sgqgpsvggq mifeehgfrr ttppttatpi
2161 rhrprpyppn vggealsqtt iswapfqdts eyiischpvg tdeeplqfry pgtstsatlt
2221 gltrgatyni ivealkdqqr hkvreevvtv gnsvneglnq ptddscfdpy tvshyavgde
2281 wermsesgfk llcqclgfgs ghfrcdssrw chdngvnyki gekwdrggen gqmmsctclg
2341 ngkgefkcdp heatcyddgk tyhvgeqwqk eylgaicsct cfggqrgwrc dncrrpggep
2401 spegttgqsy nqysqryhqr tntnvncpie cfmpldvqad redsre
```

Fibronectin 1, isoform 9 precursor, NP_001293059.1

(SEQ ID NO: 80)

```
   1 mlrgpgpgll llavqclgta vpstgasksk rqaqqmvqpq spvaysgskp gcydngkhyq
```

```
  61 inqqwertyl gnalvctcyg gsrgfncesk peaeetcfdk ytgntyrvgd tyerpkdsmi
 121 wdctcigagr grisctianr cheggqsyki gdtwrrphet ggymlecvcl gngkgewtck
 181 piaekcfdha agtsyvvget wekpyqgwmm vdctclgegs gritctsrnr cndqdtrtsy
 241 rigdtwskkd nrgnllqcic tgngrgewkc erhtsvqtts sgsgpftdvr aavyqpqphp
 301 qpppyghcvt dsgvvysvgm qwlktqgnkq mlctclgngv scqetavtqt yggnsngepc
 361 vlpftyngrt fyscttegrq dghlwcstts nyeqdqkysf ctdhtvlvqt rggnsngalc
 421 hfpflynnhn ytdctsegrr dnmkwcgttq nydadqkfgf cpmaaheeic ttnegvmyri
 481 gdqwdkqhdm ghmmrctcvg ngrgewtcia ysqlrdqciv dditynvndt fhkrheeghm
 541 lnctcfgqgr grwkcdpvdq cqdsetgtfy gigdswekyv hgvryqcycy grgigewhcq
 601 plqtypsssg pvevfitetp sqpnshpiqw napqpshisk yilrwrpkns vgrwkeatip
 661 ghlnsytikg lkpgvvyegq lisiqqyghq evtrfdfttt ststpvtsnt vtgettpfsp
 721 lvatsesvte itassfvvsw vsasdtvsgf rveyelseeg depqyldlps tatsvnipdl
 781 lpgrkyivnv ygisedgeqs lilstsqtta pdappdptvd qvddtsivvr wsrpqapitg
 841 yrivyspsve gsstelnlpe tansvtlsdl qpgvqyniti yaveengest pvviqqettg
 901 tprsdtvpsp rdlqfvevtd vkvtimwtpp esavtgyrvd vipvnlpgeh gqrlpisrnt
 961 faevtglspg vtyyfkvfav shgreskplt aqqttkldap tnlqfvnetd stvlvrwtpp
1021 raqitgyrlt vgltrrgqpr qynvgpsysk yplrnlqpas eytvslvaik gnqespkatg
1081 vfttlqpgss ippyntevte ttivitwtpa prigfklgvr psqggeapre vtsdsgsivv
1141 sgltpgveyv ytiqvlrdgq erdapivnkv vtplspptnl hleanpdtgv ltvswerstt
1201 pditgyritt tptngqqgns leevvhadqs sctfdnlspg leynvsvytv kddkesvpis
1261 dtiipevpql tdlsfvditd ssiglrwtpl nsstiigyri tvvaagegip ifedfvdssv
1321 gyytvtglep gidydisvit linggesapt tltqqtavpp ptdlrftnig pdtmrvtwap
1381 ppsidltnfl vryspvknee dvaelsisps dnavvltnll pgteyvvsys svyeghestp
1441 lrgrqktgld sptgidfsdi tansftvhwi apratitgyr irhhpehfsg rpredrvphs
1501 rnsitltnit pgteyvvsiv alngreespl ligqqstvsd vprdlevvaa tptslliswd
1561 apavtvryyr itygetggns pvqeftvpgs kstatisglk pgvdytitvy avtgrgdspa
1621 sskpisinyr teidkpsqmq vtdvgdnsis vkwlpsssspv tgyrvtttpk ngpgptktkt
1681 agpdqtemti eglqptveyv vsvyagnpsg esqplvqtav ttipaptdlk ftqvtptsls
1741 aqwtppnvql tgyrvrvtpk ektgpmkein lapdsssvvv sglmvatkye vsvyalkdtl
1801 tsrpaqgvvt tlenvspprr arvtdatett itiswrtkte titgfqvdav pangqtpiqr
1861 tikpdvrsyt itglqpgtdy kiylytlndn arsspvvida staidapsnl rflattpnsl
1921 lvswqpprar itgyiikyek pgspprevvp rprpgvteat itglepgtey tiyvialknn
1981 qksepligrk ktggealsqt tiswapfqdt seyiischpv gtdeeplqfr vpgtstsatl
2041 tgltrgatyn iivealkdqq rhkvreevvt vgnsvnegln qptddscfdp ytvshyavgd
2101 ewermsesgf kllcqclgfg sghfrcdssr wchdngvnyk igekwdrqge ngqmmsctcl
2161 gngkgefkcd pheatcyddg ktyhvgeqwq keylgaicsc tcfggqrgwr cdncrrpgge
2221 pspegttgqs ynqysqryhq rtntnvncpi ecfmpldvqa dredsre
Fibronectin 1, isoform 10 precursor, NP_001293060.1
                                                                 (SEQ ID NO: 81)
   1 mlrgpgpgll llavqclgta vpstgasksk rqaqqmvqpq spvaysgskp gcydngkhyq
  61 inqqwertyl gnalvctcyg gsrgfncesk peaeetcfdk ytgntyrvgd tyerpkdsmi
```

```
121  wdctcigagr grisctianr cheggqsyki gdtwrrphet ggymlecvcl gngkgewtck
181  piaekcfdha agtsyvvget wekpyqgwmm vdctclgegs gritctsrnr cndqdtrtsy
241  rigdtwskkd nrgnllqcic tngrgewkc  erhtsvqtts sgsgpftdvr aavyqpqphp
301  qpppyghcvt dsgvvysvgm qwlktqgnkq mlctclgngv scqetavtqt yggnsngepc
361  vlpftyngrt fyscttegrq dghlwcstts nyeqdqkysf ctdhtvlvqt rggnsngalc
421  hfpflynnhn ytdctsegrr dnmkwcgttq nydadqkfgf cpmaaheeic ttnegvmyri
481  gdqwdkqhdm ghmmrctcvg ngrgewtcia ysqlrdqciv dditynvndt fhkrheeghm
541  lnctcfgqgr grwkcdpvdq cqdsetgtfy gigdswekyv hgvryqcycy grgigewhcq
601  plqtypsssg pvevfitetp sqpnshpiqw napqpshisk yilrwrpkns vgrwkeatip
661  ghlnsytikg lkpgvvyegq lisiqqyghq evtrfdfttt ststpvtsnt vtgettpfsp
721  lvatsesvte itassfvvsw vsasdtvsgf rveyelseeg depqyldlps tatsvnipdl
781  lpgrkyivnv ygisedgeqs lilststqtta pdappdptvd qvddtsivvr wsrpqapitg
841  yrivyspsve gsstelnlpe tansvtlsdl qpgvqyniti yaveengest pvviqqettg
901  tprsdtvpsp rdlqfvevtd vkvtimwtpp esavtgyrvd vipvnlpgeh gqrlpisrnt
961  faevtglspg vtyyfkvfav shgreskplt aqqttkldap tnlqfvnetd stvlvrwtpp
1021 raqitgyrlt vgltrrgqpr qynvgpsysk yplrnlqpas eytvslvaik gnqespkatg
1081 vfttlqpgss ippyntevte ttivitwtpa prigfklgvr psqggeapre vtsdsgsivv
1141 sgltpgveyv ytiqvlrdgq erdapivnkv vtplspptnl hleanpdtgv ltvswerstt
1201 pditgyritt tptngqqgns leevvhadqs sctfdnlspg leynvsvytv kddkesvpis
1261 dtiipavppp tdlrftnigp dtmrvtwapp psidltnflv ryspvkneed vaelsispsd
1321 navvltnllp gteyvvsyss vyeghestpl rgrqktglds ptgidfsdit ansftvhwia
1381 pratitgyri rhhpehfsgr predrvphsr nsitltnitp gteyvvsiva lngreesppll
1441 igqqstvsdv prdlevvaat ptslliswda pavtvryyri tygetggnsp vqeftvpgsk
1501 statisglkp gvdytitvya vtgrgdspas skpisinyrt eidkpsqmqv tdvgdnsisv
1561 kwlpssspvt gyrvtttpkn gpgptktkta gpdqtemtie glqptveyvv svyagnpsge
1621 sqplvqtavt tipaptdlkf tqvtptslsa qwtppnvqlt gyrvrvtpke ktgpmkeinl
1681 apdsssvvvs glmvatkyev svyalkdtlt srpaqgvvtt lenvspprra rvtdatetti
1741 tiswrtktet itgfqvdavp angqtpiqrt ikpdvrsyti tglqpgtdyk iylytlndna
1801 rsspvvidas taidapsnlr flattpnsll vswqpprari tgyiikyekp gspprevvpr
1861 prpgvteati tglepgteyt iyvialknnq ksepligrkk tdelpqlvtl phpnlhgpei
1921 ldvpstvqkt pfvthpgydt gngiqlpgts gqqpsvgqqm ifeehgfrrt tppttatpir
1981 hrprpyppnv ggealsqtti swapfqdtse yiischpvgt deeplqfrvp gtststlltg
2041 ltrgatynii vealkdqqrh kvreevvtvg nsvneglnqp tddscfdpyt vshyavgdew
2101 ermsesgfkl lcgclgfgsg hfrcdssrwc hdngvnykig ekwdrqgeng qmmsctclgn
2161 gkgefkcdph eatcyddgkt yhvgeqwgke ylgaicsctc fggqrgwrcd ncrrpggeps
2221 pegttgqsyn gysqryhqrt ntnvncpiec fmpldvqadr edsre
Fibronectin 1, isoform 11 precursor, NP_001293061.1
                                                                  (SEQ ID NO: 82)
   1 mlrgpgpgll llavqclgta vpstgasksk rqaqqmvqpq spvaysgskp gcydngkhyq
  61 inqqwertyl gnalvctcyg gsrgfncesk peaeetcfdk ytgntyrvgd tyerpkdsmi
 121 wdctcigagr grisctianr cheggqsyki gdtwrrphet ggymlecvcl gngkgewtck
 181 piaekcfdha agtsyvvget wekpyqgwmm vdctclgegs gritctsrnr cndqdtrtsy
```

-continued

```
 241 rigdtwskkd nrgnllqcic tgngrgewkc erhtsvqtts sgsgpftdvr aavyqpqphp
 301 qpppyghcvt dsgvvysvgm qwlktqgnkq mlctclgngv scqetavtqt yggnsngepc
 361 vlpftyngrt fyscttegrq dghlwcstts nyeqdqkysf ctdhtvlvqt rggnsngalc
 421 hfpflynnhn ytdctsegrr dnmkwcgttq nydadqkfgf cpmaaheeic ttnegvmyri
 481 gdqwdkqhdm ghmmrctcvg ngrgewtcia ysqlrdqciv dditynvndt fhkrheeghm
 541 lnctcfgqgr grwkcdpvdq cqdsetgtfy gigdswekyv hgvryqcycy grgigewhcq
 601 plqtypsssg pvevfitetp sqpnshpiqw napqpshisk yilrwrpkns vgrwkeatip
 661 ghlnsytikg lkpgvvyegq lisiqqyghq evtrfdfttt ststpvtsnt vtgettpfsp
 721 lvatsesvte itassfvvsw vsasdtvsgf rveyelseeg depqyldlps tatsvnipdl
 781 lpgrkyivnv ygisedgeqs lilstsqtta pdappdptvd qvddtsivvr wsrpqapitg
 841 yrivyspsve gsstelnlpe tansvtlsdl qpgvqyniti yaveengest pvviqqettg
 901 tprsdtvpsp rdlqfvevtd vkvtimwtpp esavtgyrvd vipvnlpgeh gqrlpisrnt
 961 faevtglspg vtyyfkvfav shgreskplt aqqttkldap tnlqfvnetd stvlvrwtpp
1021 raqitgyrlt vgltrrgqpr qynvgpsysk yplrnlqpas eytvslvaik gnqespkatg
1081 vfttlqpgss ippyntevte ttivitwtpa prigfklgvr psqggeapre vtsdsgsivv
1141 sgltpgveyv ytiqvlrdgq erdapivnkv vtplspptnl hleanpdtgv ltvswerstt
1201 pditgyritt tptngqqgns leevvhadqs sctfdnlspg leynvsvytv kddkesvpis
1261 dtiipavppp tdlrftnigp dtmrvtwapp psidltnflv ryspvkneed vaelsispsd
1321 navvltnllp gteyvvsyss vyeghestpl rgrqktglds ptgidfsdit ansftvhwia
1381 pratitgyri rhhpehfsgr predrvphsr nsitltnitp gteyvvsiva lngreespll
1441 igqqstvsdv prdlevvaat ptslliswda pavtvryyri tygetggnsp vqeftvpgsk
1501 statisglkp gvdytitvya vtgrgdspas skpisinyrt eidkpsqmqv tdvgdnsisv
1561 kwlpssspvt gyrvtttpkn gpgptktkta gpdqtemtie glqptveyvv svyagnpsge
1621 sqplvqtavt tipaptdlkf tqvtptslsa qwtppnvqlt gyrvrvtpke ktgpmkeinl
1681 apdsssvvvs glmvatkyev svyalkdtlt srpaqgvvtt lenvspprra rvtdatetti
1741 tiswrtktet itgfqvdavp angqtpiqrt ikpdvrsyti tglqpgtdyk iylytlndna
1801 rsspvvidas taidapsnlr flattpnsll vswqpprari tgyiikyekp gspprevvpr
1861 prpgvteati tglepgteyt iyvialknnq ksepligrkk tvqktpfvth pgydtgngiq
1921 lpgtsgqqps vgqqmifeeh gfrrttpptt atpirhrprp yppnvggeal sqttiswapf
1981 qdtseyiisc hpvgtdeepl qfrvpgtsts atltgltrga tyniivealk dqqrhkvree
2041 vvtvgnsvne glnqptddsc fdpytvshya vgdewermse sgfkllcgcl gfgsghfrcd
2101 ssrwchdngv nykigekwdr ggengqmmsc tclgngkgef kcdpheatcy ddgktyhvge
2161 qwqkeylgai csctcfggqr gwrcdncrrp ggepspegtt ggsynqysqr yhqrtntnvn
2221 cpiecfmpld vqadredsre
```

Major histocompatibility complex, class II, DR beta 1, precursor, NP_001230894.1

(SEQ ID NO: 83)

```
   1 mvclrlpggs cmavltvtlm vlssplalag dtrprfleys tsechffngt ervryldryf
  61 hnqeenvrfd sdvgefravt elgrpdaeyw nsqkdlleqk rgrvdnycrh nygvvesftv
 121 qrrvhpkvtv ypsktqplqh hnllvcsysg fypgsievrw frnggeektg vvstglihng
 181 dwtfqtivml etvprsgevy tcqvehpsvt spltvewrar sesagskmls gvggfvlgll
 241 flgaglfiyf rnqkghsglq prgfls
```

Major histocompatibility complex, class II, DR beta 1, precursor,
NP_001346122.1

(SEQ ID NO: 84)

```
  1 mvclklpggs cmaaltvtlm vlssplalag dtqprflwqg kykchffngt ervqflerlf
 61 ynqeefvrfd sdvgeyravt elgrpvaesw nsqkdiledr rgqvdtvcrh nygvgesftv
121 qrrvhpevtv ypaktqplqh hnllvcsysg fypgsievrw frngqeekag vvstgliqng
181 dwtfqtivml etvprsgevy tcqvehpsvm spltvewrar sesagskmls gvggfvlgll
241 flgaglfiyf rnqkghsglq ptgfls
```

Major histocompatibility complex, class II, DR beta 1, precursor,
NP_001346123.1

(SEQ ID NO: 85)

```
  1 mvclkfpggs cmaaltvtlm vlssplalag dtrprfleqv khechffngt ervrfldryf
 61 yhqeeyvrfd sdvgeyravt elgrpdaeyw nsqkdlleqr raevdtycrh nygvvesftv
121 qrrvypevtv ypaktqplqh hnllvcsvng fypgsievrw frnggeektg vvstgliqng
181 dwtfqtivml etvprsgevy tcqvehpslt spltvewrar sesagskmls gvggfvlgll
241 flgaglfiyf rnqkghsglq ptgfls
```

Major histocompatibility complex, class II, DR beta 1, precursor,
NP_002115.2

(SEQ ID NO: 86)

```
  1 mvclklpggs cmtaltvtlm vlssplalsg dtrprflwqp krechffngt ervrfldryf
 61 ynqeesvrfd sdvgefravt elgrpdaeyw nsqkdileqa raavdtycrh nygvvesftv
121 qrrvqpkvtv ypsktqplqh hnllvcsysg fypgsievrw flnggeekag mvstgliqng
181 dwtfqtivml etvprsgevy tcqvehpsvt spltvewrar sesagskmls gvggfvlgll
241 flgaglfiyf rnqkghsglq ptgfls
```

Major histocompatibility complex, class II, DR beta 5, precursor,
NP_002116.2

(SEQ ID NO: 87)

```
  1 mvclklpggs ymakltvtlm vlssplalag dtrprflqqd kyechffngt ervrflhrdi
 61 ynqeedlrfd sdvgeyravt elgrpdaeyw nsqkdfledr raavdtycrh nygvgesftv
121 qrrvepkvtv ypartqtlqh hnllvcsvng fypgsievrw frnsgeekag vvstgliqng
181 dwtfqtivml etvprsgevy tcqvehpsvt spltvewraq sesagskmls gvggfvlgll
241 flgaglfiyf knqkghsglh ptglvs
```

Hydroxysteroid 17-beta dehydrogenase 3, NP_000188.1

(SEQ ID NO: 88)

```
  1 mgdvleqffi ltgllvclac lakcvrfsrc vllnywkvlp ksflrsmgqw avitgagdgi
 61 gkaysfelak rglnvvlisr tlekleaiat eierttgrsv kiiqadftkd diyehikekl
121 agleigilvn nvgmlpnllp shflnapdei qslihcnits vvkmtqlilk hmesrqkgli
181 lnissgialf pwplysmysa skafvcafsk algeeykake viiqvltpya vstamtkyln
241 tnvitktade fvkeslnyvt iggetcgcla heilagflsl ipawafysga fqrllthyv
301 aylklntkvr
```

Insulin degrading enzyme, isoform 1, NP_004960.2

(SEQ ID NO: 89)

```
  1 mryrlawllh palpstfrsv lgarlppper lcgfqkktys kmnnpaikri gnhitksped
 61 kreyrglela ngikvllisd pttdkssaal dvhigslsdp pniaglshfc ehmlflgtkk
121 ypkeneysqf lsehagssna ftsgehtnyy fdvshehleg aldrfaqffl cplfdesckd
181 revnavdseh eknvmndawr lfqlekatgn pkhpfskfgt gnkytletrp nqegidvrge
241 llkfhsayys snlmavcvlg reslddltnl vvklfseven knvplpefpe hpfgeehlkg
301 lykivpikdi rnlyvtfpip dlqkyyksnp ghylghligh egpgsllsel kskgwvntiv
```

```
361 ggqkegargf mffiinvdlt eegllhvedi ilhmfqyiqk lraegpqewv fgeckdlnav 421 afrfkdkerp rgytskiagi lhyypleevl taeylleefr pdliemvldk lrpenvrvai 481 vsksfegktd rteewygtqy kqeaipdevi kkwqnadlng kfklptknef iptnfeilpl 541 ekeatpypal ikdtamsklw fkqddkfflp kaclnfeffs pfayvdplhc nmaylylell 601 kdslneyaya aelaglsydl qntiygmyls vkgyndkqpi llkkiiekma tfeidekrfe 661 iikeaymrsl nnfraeqphq hamyylrllm tevawtkdel kealddvtlp rlkafipqll 721 srlhieallh gnitkqaalg imqmvedtli ehahtkpllp sqlvryrevq lpdrgwfvyq 781 qrnevhnncg ieiyyqtdmq stsenmflel fcqiisepcf ntlrtkeqlg yivfsgprra 841 ngiqglrfii qsekpphyle srveaflitm eksiedmtee afqkhiqala irrldkpkkl 901 saecakywge iisqqynfdr dntevaylkt ltkediikfy kemlavdapr rhkvsvhvla 961 remdscpvvg efpcqndinl sqapalpqpe vignmtefkr glplfplvkp hinfmaakl
```

Insulin degrading enzyme, isoform 2, NP_001159418.1

(SEQ ID NO: 90)
```
  1 msklwfkqdd kfflpkacln feffspfayv dplhcnmayl ylellkdsln eyayaaelag 61 lsydlqntiy gmylsvkgyn dkqpillkki iekmatfeid ekrfeiikea ymrslnnfra 121 eqphqhamyy lrllmtevaw tkdelkeald dvtlprlkaf ipqllsrlhi eallhgnitk 181 qaalgimqmv edtliehaht kpllpsqlvr yrevqlpdrg wfvyqqrnev hnncgieiyy 241 qtdmqstsen mflelfcqii sepcfntlrt keqlgyivfs gprrangiqg lrfiiqsekp 301 phylesrvea flitmeksie dmteeafqkh iqalairrld kpkklsaeca kywgeiisqq 361 ynfdrdntev aylktltked iikfykemla vdaprrhkvs vhvlaremds cpvvgefpcq 421 ndinlsqapa lpqpevignm tefkrglplf plvkphinfm aakl
```

Insulin degrading enzyme, isoform 3, NP_001309722.1

(SEQ ID NO: 91)
```
  1 mryrlawllh palpstfrsv lgarlppper lcgfqkktys kmnnpaikri gnhitksped 61 kreyrglela ngikvllisd pttdkssaal dvhigslsdp pniaglshfc ehmlflgtkk 121 ypkeneysqf lsehagssna ftsgehtnyy fdvshehleg aldrfaqffl cplfdesckd 181 revnavdseh eknvmndawr lfqlekatgn pkhpfskfgt gnkytletrp ngegidvrge 241 llkfhsayys snlmavcvlg reslddltnl vvklfseven knvplpefpe hpfgeehlkg 301 lykivpikdi rnlyvtfpip dlqkyyksnp ghylghligh egpgsllsel kskgwvntiv 361 ggqkegargf mffiinvdlt eegllhvedi ilhmfqyiqk lraegpqewv fgeckdlnav 421 afrfkdkerp rgytskiagi lhyypleevl taeylleefr pdliemvldk lrpenvrvai 481 vsksfegktd rteewygtqy kqeaipdevi kkwqnadlng kfklptknef iptnfeilpl 541 ekeatpypal ikdtamsklw fkqddkfflp kaclnfeffs ryiyadplhc nmtylfirll 601 kddlkeytya arlsglsygi asgmnaills vkgyndkqpi llkkiiekma tfeidekrfe 661 iikeaymrsl nnfraeqphq hamyylrllm tevawtkdel kealddvtlp rlkafipqll 721 srlhieallh gnitkqaalg imqmvedtli ehahtkpllp sqlvryrevq lpdrgwfvyq 781 qrnevhnncg ieiyyqtdmq stsenmflel fcqiisepcf ntlrtkeqlg yivfsgprra 841 ngiqglrfii qsekpphyle srveaflitm eksiedmtee afqkhiqala irrldkpkkl 901 saecakywge iisqqynfdr dntevaylkt ltkediikfy kemlavdapr rhkvsvhvla 961 remdscpvvg efpcqndinl sqapalpqpe vignmtefkr glplfplvkp hinfmaakl
```

Insulin degrading enzyme, isoform 4, NP_001309723.1

(SEQ ID NO: 92)
```
  1 mryrlawllh palpstfrsv lgarlppper lcgfqkktys kmnnpaikri gnhitksped 61 kreyrglela ngikvllisd pttdkssaal dvhigslsdp pniaglshfc ehmlflgtkk
```

```
121 ypkeneysqf lsehagssna ftsgehtnyy fdvshehleg aldrfaqffl cplfdesckd 181 revnavdseh eknvmndawr lfqlekatgn pkhpfskfgt gresldditn lvvklfseve 241 nknvplpefp ehpfqeehlk qlykivpikd irnlyvtfpi pdlqkyyksn pghylghlig 301 hegpgsllse lkskgwvntl vggqkegarg fmffiinvdl teegllhved iilhmfgyiq 361 klraegpqew vfqeckdlna vafrfkdker prgytskiag ilhyypleev ltaeylleef 421 rpdliemvld klrpenvrva ivsksfegkt drteewygtq ykqeaipdev ikkwqnadln 481 gkfklptkne fiptnfeilp lekeatpypa likdtamskl wfkqddkffl pkaclnfeff 541 spfayvdplh cnmaylylel lkdslneyay aaelaglsyd lqntiygmyl svkgyndkqp 601 illkkiiekm atfeidekrf eiikeaymrs lnnfraeqph ghamyylrll mtevawtkde 661 lkealddvtl prlkafipql lsrlhieall hgnitkqaal gimqmvedtl iehahtkpll 721 psqlvryrev qlpdrgwfvy qqrnevhnnc gieiyyqtdm qstsenmfle lfcqiisepc 781 fntlrtkeql gyivfsgprr angiqglrfi igsekpphyl esrveaflit meksiedmte 841 eafqkhigal airrldkpkk lsaecakywg eiisqqynfd rdntevaylk tltkediikf 901 ykemlavdap rrhkvsvhvl aremdscpvv gefpcqndin lsqapalpqp eviqnmtefk 961 rglplfplvk phinfmaakl Insulin degrading enzyme, isoform 5, NP_001309724.1, NP_001309725.1
                                                                 (SEQ ID NO: 93)
  1 mnnpaikrig nhitkspedk reyrglelan gikvllisdp ttdkssaald vhigslsdpp 61 niaglshfce hmlflgtkky pkeneysqfl sehagssnaf tsgehtnyyf dvshehlega 121 ldrfaqfflc plfdesckdr evnavdsehe knvmndawrl fqlekatgnp khpfskfgtg 181 nkytletrpn gegidvrgel lkfhsayyss nlmavcvlgr esldditnlv vklfsevenk 241 nvplpefpeh pfqeehlkql ykivpikdir nlyvtfpipd lqkyyksnpg hylghlighe 301 gpgsllselk skgwvntivg gqkegargfm ffiinvdlte egllhvedii lhmfgyigkl 361 raegpgewvf qeckdlnava frfkdkerpr gytskiagil hyypleevlt aeylleefrp 421 dliemvldkl rpenvrvaiv sksfegktdr teewygtqyk qeaipdevik kwqnadlngk 481 fklptknefi ptnfeilple keatpypali kdtamsklwf kqddkfflpk aclnfeffsp 541 fayvdplhcn maylylellk dslneyayaa elaglsydlq ntiygmylsv kgyndkqpil 601 lkkiiekmat feidekrfei ikeaymrsln nfraeqphqh amyylrllmt evawtkdelk 661 ealddvtlpr lkafipqlls rlhieallhg nitkqaalgi mqmvedtlie hahtkpllps 721 qlvryrevql pdrgwfvyqq rnevhnncgi eiyyqtdmqs tsenmflelf cqiisepcfn 781 tlrtkeqlgy ivfsgprran gigglrfiiq sekpphyles rveaflitme ksiedmteea 841 fqkhigalai rrldkpkkls aecakywgei isqqynfdrd ntevaylktl tkediikfyk 901 emlavdaprr hkvsvhvlar emdscpvvge fpcqndinls qapalpqpev iqnmtefkrg 961 lplfplvkph infmaakl Insulin degrading enzyme, isoform 6, NP_001309726.1
                                                                 (SEQ ID NO: 94)
  1 msklwfkqdd kfflpkacln feffsryiya dplhcnmtyl firllkddlk eytyaarlsg 61 lsygiasgmn aillsvkgyn dkqpillkki iekmatfeid ekrfeiikea ymrslnnfra 121 eqphqhamyy lrllmtevaw tkdelkeald dvtlprlkaf ipqllsrlhi eallhgnitk 181 qaalgimqmv edtliehaht kpllpsqlvr yrevqlpdrg wfvyqqrnev hnncgieiyy 241 qtdmqstsen mflelfcqii sepcfntlrt keqlgyivfs gprrangiqg lrfiiqsekp 301 phylesrvea flitmeksie dmteeafqkh iqalairrld kpkklsaeca kywgeiisqq
```

-continued

```
361 ynfdrdntev aylktltked iikfykemla vdaprrhkvs vhvlaremds cpvvgefpcq 421 ndinlsqapa lpqpevignm tefkrglplf plvkphinfm aakl
```

Indoleamine 2,3-dioxygenase 1, NP_002155.1
(SEQ ID NO: 95)
```
  1 mahamenswt iskeyhidee vgfalpnpqe nlpdfyndwm fiakhlpdli esgqlrerve 61 klnmlsidhl tdhksqrlar lvlgcitmay vwgkghgdvr kvlprniavp ycqlskklel 121 ppilvyadcv lanwkkkdpn kpltyenmdv lfsfrdgdcs kgfflvsllv eiaaasaikv 181 iptvfkamqm gerdtllkal leiasclekа lqvfhqihdh vnpkaffsvl riylsgwkgn 241 pqlsdglvye gfwedpkefa ggsagqssvf qcfdvllgiq qtaggghaaq flqdmrrymp 301 pahrnflcsl esnpsvrefv lskgdaglre aydacvkalv slrsyhlqiv tkyilipasq 361 qpkenktsed pskleakgtg gtdlmnflkt vrstteksll keg
```

Insulin like growth factor binding protein 5, precursor, NP_000590.1
(SEQ ID NO: 96)
```
  1 mvlltavlll laayagpaqs lgsfvhcepc dekalsmcpp splgcelvke pgcgccmtca 61 laegqscgvy tercagglrc lprqdeekpl hallhgrgvc lneksyreqv kierdsrehe 121 epttsemaee tyspkifrpk htriselkae avkkdrrkkl tqskfvggae ntahpriisa 181 pemrqeseqg pcrrhmeasl qelkasprmv pravylpncd rkgfykrkqc kpsrgrkrgi 241 cwcvdkygmk lpgmeyvdgd fqchtfdssn ve
```

Insulin like growth factor binding protein 7, isoform 1 precursor, NP_001544.1
(SEQ ID NO: 97)
```
  1 merpslrall lgaaglllll lplssssssd tcgpcepasc pplpplgcll getrdacgcc 61 pmcargegep cggggagrgy capgmecvks rkrrkgkaga aaggpgvsgv cvcksrypvc 121 gsdgttypsg cqlraasqra esrgekaitq vskgtceqgp sivtppkdiw nvtgaqvyls 181 cevigiptpv liwnkvkrgh ygvqrtellp gdrdnlaiqt rggpekhevt gwvlvsplsk 241 edageyecha snsqggasas akitvvdalh eipvkkgega el
```

Insulin like growth factor binding protein 7, isoform 2 precursor, NP_001240764.1
(SEQ ID NO: 98)
```
  1 merpslrall lgaaglllll lplssssssd tcgpcepasc pplpplgcll getrdacgcc 61 pmcargegep cggggagrgy capgmecvks rkrrkgkaga aaggpgvsgv cvcksrypvc 121 gsdgttypsg cqlraasqra esrgekaitq vskgtceqgp sivtppkdiw nvtgaqvyls 181 cevigiptpv liwnkvkrgh ygvqrtellp gdrdnlaiqt rggpekhevt gwvlvsplsk 241 edageyecha snsqggasas akitvvdalh eipvkkgtq
```

Potassium two pore domain channel subfamily K member 1, NP_002236.1
(SEQ ID NO: 99)
```
  1 mlqslagssc vrlverhrsa wcfgflvlgy llylvfgavv fssvelpyed llrgelrklk 61 rrfleehecl segglegflg rvleasnygv svlsnasgnw nwdftsalff astvlsttgy 121 ghtvplsdgg kafciiysvi gipftllflt avvqritvhv trrpvlyfhi rwgfskqvva 181 ivhavllgfv tvscfffipa avfsvleddw nflesfyfcf islstiglgd yvpgegynqk 241 frelykigit cylllgliam lvvletfcel helkkfrkmf yvkkdkdedq vhiiehdqls 301 fssitdqaag mkedqkqnep fvatqssacv dgpanh
```

Lysosomal associated membrane protein 3, precursor, NP_055213.2
(SEQ ID NO: 100)
```
  1 mprqlsaaaa lfaslavilh dgsqmrakaf petrdysqpt aaatvgdikk pvggpakqap 61 hqtlaarfmd ghitfqtaat vkiptttpat tkntattspi tytivttqat pnnshtappv 121 tevtvgpsla pyslpptitp pahttgtsss tvshttgntt gpsnqttlpa tlsialhkst 181 tgqkpvqpth apgttaaahn ttrtaapast vpgptlapqp ssvktgiyqv lngsrlcika
```

```
241 emgiqlivqd kesvfsprry fnidpnatqa sgncgtrksn lllnfqggfv nitftkdees 301 yyisevgayl tvsdpetiyq gikhavvmfq tavghsfkcv segslqlsah lqvkttdvql 361 qafdfeddhf gnvdecssdy tivlpvigai vvglclmgmg vykirlrcqs sgyqri
```

MAGE family member B2, NP_002355.2

(SEQ ID NO: 101)
```
  1 mprgqksklr arekrrkard etrglnvpqv teaeeeeapc csssysggaa ssspaagipq 61 epqrapttaa aaaagvsstk skkgakshqg eknasssqas tstkspsedp ltrksgslvq 121 fllykykikk svtkgemlki vgkrfrehfp eilkkasegl svvfglelnk vnpnghtytf 181 idkvdltdee sllsswdfpr rkllmpllgv iflngnsate eeiweflnml gvydgeehsv 241 fgepwklitk dlvqekyley kqvpssdppr fqflwgpray aetskmkvle flakvngttp 301 cafpthyeea lkdeekagv
```

Mitogen-activated protein kinase 13, NP_002745.1

(SEQ ID NO: 102)
```
  1 mslirkkgfy kqdvnktawe lpktyvspth vgsgaygsvc saidkrsgek vaikklsrpf 61 qseifakray rellllkhmq henviglldv ftpasslrnf ydfylvmpfm qtdlqkimgm 121 efseekigyl vygmlkglky ihsagvvhrd lkpgnlavne dcelkildfg larhadaemt 181 gyvvtrwyra pevilswmhy nqtvdiwsvg cimaemltgk tlfkgkdyld qltgilkvtg 241 vpgtefvqkl ndkaaksyiq slpqtprkdf tqlfpraspq aadllekmle ldvdkrltaa 301 qalthpffep frdpeeetea qqpfddsleh ekltvdewkq hiykeivnfs piarkdsrrr 361 sgmkl
```

Macrophage receptor with collagenous structure, NP_006761.1

(SEQ ID NO: 103)
```
  1 mrnkkilked ellsetqqaa fhqiamepfe invpkpkrrn gvnfslavvv iylilltaga 61 gllvvqvinl qarlrvlemy flndtlaaed spsfsllqsa hpgehlaqga srlqvlqaql 121 twvrvshehl lqrvdnftqn pgmfrikgeq gapglqghkg amgmpgapgp pgppaekgak 181 gamgrdgatg psgpqgppgv kgeaglqgpq gapgkqgatg tpgpqgekgs kgdggligpk 241 getgtkgekg dlglpgskgd rgmkgdagvm gppgaqgskg dfgrpgppgl agfpgakgdg 301 gqpglqgvpg ppgavghpga kgepgsagsp graglpgspg spgatglkgs kgdtglqgqq 361 grkgesgvpg pagvkgeqgs pglagpkgap ggagqkgdqg vkgssgeqgv kgekgergen 421 sysvrivgss nrgraevyys gtwgticdde wqnsdaivfc rmlgyskgra lykvgagtgq 481 iwldnvqcrg testlwsctk nswghhdcsh eedagvecsv
```

Malic enzyme 1, NADP-dependent malic enzyme, NP_002386.1

(SEQ ID NO: 104)
```
  1 mepeaprrrh thqrgyllltr nphlnkdlaf tleerqqlni hgllppsfns geiqvlrvvk 61 nfehlnsdfd rylllmdlqd rneklfyrvl tsdiekfmpi vytptvglac qqyslvfrkp 121 rglfitihdr ghiasvinaw pedvikaivv tdgerilglg dlcngmgip vgklalytac 181 ggmnpqeclp vildvgtene ellkdplyig lrqrrvrgse yddfldefme aysskygmnc 241 liqfedfanv nafrllnkyr nqyctfnddi qgtasvavag llaalritkn klsdqtilfq 301 gageaalgia hlivmaleke glpkekaikk iwlvdskgli vkgrasltqe kekfahehee 361 mknleaivqe ikptaligva aiggafseqi lkdmaafner piifalsnpt skaecsaeqc 421 ykitkgraif asgspfdpvt lpngqtlypg qgnnsyvfpg valgvvacgl rqitdniflt 481 taeviaqqvs dkhleegrly ppintirdvs lkiaekivkd ayqektatvy pepqnkeafv 541 rsqmystdyd qilpdcyswp eevqkiqtkv dq
```

-continued

Migration and invasion inhibitory protein, NP_068752.2
(SEQ ID NO: 105)

```
  1 mveaeelaql rllnlellrq lwvggdavrr svaraasess lessssynse tpstpetsst 61 slstscprgr ssvwgppdac rgdlrdvars gvaslppakc qhqeslgrpr phsapslgts 121 slrdpepsgr lgdpgpqeaq tprsilaqqs klskprvtfs eesavpkrsw rlrpylgydw 181 iagsldtsss itsgpeaffs klqefretnk eecicshpep qlpglressg sgveedhecv 241 ycyrvnrrlf pvpvdpgtpc rlcrtprdqg gpgtlaqpah vrvsiplsil epphryhihr 301 rksfdasdtl alprhcllgw difppkseks saprnldlws sysaeaqhqk lsgtsspfhp 361 aspmqmlppt ptwsvpqvpr phvprqkp
```

Matrix metallopeptidase 12, macrophage metalloelastase preproprotein,
NP_002417.2
(SEQ ID NO: 106)

```
  1 mkfllilllq atasgalpin sstsleknnv lfgerylekf ygleinklpv tkmkysgnlm 61 kekiqemqhf lglkvtgqld tstlemmhap rcgvpdvhhf rempggpvwr khyityrinn 121 ytpdmnredv dyairkafqv wsnvtplkfs kintgmadil vvfargahgd fhafdgkggi 181 lahafgpgsg iggdahfded efwtthsggt nlfltavhei ghslglghss dpkavmfpty 241 kyvdintfrl saddirgiqs lygdpkenqr lpnpdnsepa lcdpnlsfda vttvgnkiff 301 fkdrffwlkv serpktsvnl isslwptlps gieaayeiea rnqvflfkdd kywlisnlrp 361 epnypksihs fgfpnfvkki daavfnprfy rtyffvdnqy wryderrqmm dpgypklitk 421 nfqgigpkid avfysknkyy yffqgsnqfe ydfllgritk tlksnswfgc
```

Matrix metallopeptidase 7, matrilysin preproprotein, NP_002414.1
(SEQ ID NO: 107)

```
  1 mrltvlcavc llpgslalpl pqeaggmsel qwegagdylk rfylydsetk nansleaklk 61 emqkffglpi tgmlnsrvie imqkprcgvp dvaeyslfpn spkwtskvvt yrivsytrdl 121 phitvdrlvs kalnmwgkei plhfrkvvwg tadimigfar gahgdsypfd gpgntlahaf 181 apgtglggda hfdederwtd gsslginfly aathelghsl gmghssdpna vmyptygngd 241 pqnfklsqdd ikgiqklygk rsnsrkk
```

Myelin protein zero like 1, myelin protein zero-like protein 1
isoform a precursor, NP_003944.1
(SEQ ID NO: 108)

```
  1 maasagagav iaapdsrrwl wsvlaaalgl ltagvsalev ytpkeifvan gtqgkltckf 61 kststtgglt syswsfqpeg adttvsffhy sqgqvylgny ppfkdriswa gdldkkdasi 121 nienmqfihn gtyicdvknp pdivvqpghi rlyvvekenl pvfpvwvvvg ivtavvlglt 181 llismilavl yrrknskrdy tgcstsesls pvkqaprksp sdteglvksl psgshqgpvi 241 yaqldhsggh hsdkinkses vvyadirkn
```

Myelin protein zero like 1, myelin protein zero-like protein 1
isoform b precursor, NP_078845.3
(SEQ ID NO: 109)

```
  1 maasagagav iaapdsrrwl wsvlaaalgl ltagvsalev ytpkeifvan gtqgkltckf 61 kststtgglt syswsfqpeg adttvsffhy sqgqvylgny ppfkdriswa gdldkkdasi 121 nienmqfihn gtyicdvknp pdivvqpghi rlyvvekenl pvfpvwvvvg ivtavvlglt 181 llismilavl yrrknskrdy tgaqsymhs
```

Myelin protein zero like 1, myelin protein zero-like protein 1
isoform c precursor, NP_001139663.1
(SEQ ID NO: 110)

```
  1 maasagagav iaapdsrrwl wsvlaaalgl ltagvsalev ytpkeifvan gtqgkltckf 61 kststtgglt syswsfqpeg adttvsgpvi yaqldhsggh hsdkinkses vvyadirkn
```

Macrophage scavenger receptor 1, macrophage scavenger receptor
types I and II isoform type 1, NP_619729.1

-continued (SEQ ID NO: 111)
```
  1 meqwdhfhnq qedtdscses vkfdarsmta llppnpknsp slgeklksfk aalialyllv
 61 favlipligi vaaqllkwet kncsysstna nditqsltgk gndseeemrf qevfmehmsn
121 mekriqhild meanlmdteh fqnfsmttdq rfndillqls tlfssvqghg naideisksl
181 islnttlldl qlnienlngk igentfkqqe eiskleervy nvsaeimamk eegvhlegei
241 kgevkvinni tndlrlkdwe hsqtlrnitl iqgppgppge kgdrgptges gprgfpgpig
301 ppglkgdrga igfpgsrglp gyagrpgnsg pkgqkgekgs gntltpftkv rlvggsgphe
361 grveilhsgq wgticddrwe vrvgqvvcrs lgypgvgavh kaahfgqgtg piwlnevfcf
421 gressieeck irqwgtracs hsedagvtct l
```

Macrophage scavenger receptor 1, macrophage scavenger receptor types I and II isoform type 2, NP_002436.1

(SEQ ID NO: 112)
```
  1 meqwdhfhnq qedtdscses vkfdarsmta llppnpknsp slgeklksfk aalialyllv
 61 favlipligi vaaqllkwet kncsysstna nditqsltgk gndseeemrf qevfmehmsn
121 mekriqhild meanlmdteh fqnfsmttdq rfndillqls tlfssvqghg naideisksl
181 islnttlldl qlnienlngk igentfkqqe eiskleervy nvsaeimamk eegvhlegei
241 kgevkvinni tndlrlkdwe hsqtlrnitl iqgppgppge kgdrgptges gprgfpgpig
301 ppglkgdrga igfpgsrglp gyagrpgnsg pkgqkgekgs gntlrpvqlt dhiragps
```

Macrophage scavenger receptor 1, macrophage scavenger receptor types I and II isoform type 3, NP_619730.1

(SEQ ID NO: 113)
```
  1 meqwdhfhnq qedtdscses vkfdarsmta llppnpknsp slgeklksfk aalialyllv
 61 favlipligi vaaqllkwet kncsysstna nditqsltgk gndseeemrf qevfmehmsn
121 mekriqhild meanlmdteh fqnfsmttdq rfndillqls tlfssvqghg naideisksl
181 islnttlldl qlnienlngk igentfkqqe eiskleervy nvsaeimamk eegvhlegei
241 kgevkvinni tndlrlkdwe hsqtlrnitl iqgppgppge kgdrgptges gprgfpgpig
301 ppglkgdrga igfpgsrglp gyagrpgnsg pkgqkgekgs gntlstgpiw lnevfcfgre
361 ssieeckirq wgtracshse dagvtctl
```

Myoneurin, isoform A, NP_001172047.1, NP_061127.1

(SEQ ID NO: 114)
```
  1 mqyshhcehl lerinkgrea gflcdctivi gefqfkahrn vlasfseyfg aiyrstsenn
 61 vfldqsqvka dgfqkllefi ytgtlnldsw nvkeihqaad ylkveevvtk ckikmedfaf
121 ianpssteis sitgnielnq qtclltlrdy nnreksevst dliganpkqg alakkssqtk
181 kkkafnspk tgqnktvgyp sdilenasve lfldanklpt pvveqvaqin dnseleltsv
241 ventfpaqdi vhtvtvkrkr gksqpncalk ehsmsniasv kspyeaensg eeldqryska
301 kpmcntcgkv fseasslrrh mrihkgvkpy vchlcgkaft qcnqlkthvr thtgekpykc
361 elcdkgfaqk cqlvfhsrmh hgeekpykcd vcnlqfatss nlkiharkhs gekpyvcdrc
421 gqrfagastl tyhvrrhtge kpyvcdtcgk afaysslit hsrkhtgekp yicgicksf
481 issgelnkhf rshtgerpfi celcgnsytd iknlkkhktk vhsgadktld ssaedhtlse
541 qdsigksplns etmdvkpsdm tlplalplgt edhhmllpvt dtgsptsdtl lrstvngyse
601 pqliflqqly
```

Myoneurin, isoform B, NP_001172048.1

(SEQ ID NO: 115)
```
  1 mqyshhcehl lerinkgrea gflcdctivi gefqfkahrn vlasfseyfg aiyrstsenn
 61 vfldqsqvka dgfqkllefi ytgtlnldsw nvkeihqaad ylkveevvtk ckikmedfaf
121 ianpssteis sitgnielnq qtclltlrdy nnreksevst dliganpkqg alakkssqtk
```

```
181 kkkkafnspk tgqnktvgyp sdilenasve lfldanklpt pvveqvaqin dnseleltsv 241 ventfpaqdi vhtvtvkrkr gksqpncalk ehsmsniasv kspyeaensg eeldqryska 301 kpmcntcgkv fseasslrrh mrihkgvkpy vchlcgkaft qcnqlkthvr thtgekpykc 361 elcdkgfaqk cqlvfhsrmh hgeekpykcd vcnlqfatss nlkiharkhs gekpyvcdrc 421 gqrfagastl tyhvrrhtge kpyvcdtcgk afayssslit hsrkhtgekp yicgicgksf 481 issgelnkhf rshtgadktl dssaedhtls eqdsigkspl setmdvkpsd mtlplalplg 541 tedhhmllpv tdtqsptsdt llrstvngys epgliflqql y
```

N-acetylglucosamine kinase, isoform 1, NP_060037.3
(SEQ ID NO: 116)
```
  1 mrtrtgsqla arevtgsgav prqlegrrcq agrdanggts sdgsssmaai yggvegggtr 61 sevllvsedg kilaeadgls tnhwligtdk cverinemvn rakrkagvdp lvplrslgls 121 lsggdqedag rilieelrdr fpylsesyli ttdaagsiat atpdggvvli sgtgsncrli 181 npdgsesgcg gwghmmgdeg saywiahqav kivfdsidnl eaaphdigyv kqamfhyfqv 241 pdrlgilthl yrdfdkcrfa gfcrkiaega qqgdplsryi frkagemlgr hivavlpeid 301 pvlfqgkigl pilcvgsvwk swellkegfl laltggreig agnffssftl mklrhssalg 361 gaslgarhig hllpmdysan aiafysytfs
```

N-acetylglucosamine kinase, isoform 2, NP_001317354.1, NP_001317355.1
(SEQ ID NO: 117)
```
  1 mvnrakrkag vdplvplrsl glslsggdge dagrilieel rdrfpylses ylittdaags 61 iatatpdggv vlisgtgsnc rlinpdgses gcggwghmmg degsaywiah qavkivfdsi 121 dnleaaphdi gyvkqamfhy fqvpdrlgil thlyrdfdkc rfagfcrkia egaqqgdpls 181 ryifrkagem lgrhivavlp eidpvlfqgk iglpilcvgs vwkswellke gfllaltqgr 241 eiqaqnffss ftlmklrhss alggaslgar highllpmdy sanaiafysy tfs
```

Napsin A aspartic peptidase, preproprotein, NP_004842.1
(SEQ ID NO: 118)
```
  1 mspppllqpl llllpllnve psgatlirip lhrvqpgrri lnllrgwrep aelpklgaps 61 pgdkpifvpl snyrdvqyfg eiglgtppqn ftvafdtgss nlwvpsrrch ffsvpcwlhh 121 rfdpkasssf qangtkfaig ygtgrvdgil sedkltiggi kgasvifgea lwepslvfaf 181 ahfdgilglg fpilsvegvr ppmdvlveqg lldkpvfsfy lnrdpeepdg gelvlggsdp 241 ahyippltfv pvtvpaywqi hmervkvgpg lticakgcaa ildtgtslit gpteeiralh 301 aaiggiplla geyiilcsei pklpaysfll ggvwfnitah dyviqttrng vrlclsgfqa 361 ldvpppagpf wilgdvflgt yvavfdrgdm kssarvglar artrgadlgw getaqaqfpg
```

Nuclear transcription factor Y subunit gamma, isoform 1, NP_001136060.1
(SEQ ID NO: 119)
```
  1 msteggfggt sssdaqqslq sfwprvmeei rnitvkdfry qelplarikk imkldedvkm 61 isaeapvlfa kaaqifitel tlrawihted nkrrtlqrnd iamaitkfdq fdflidivpr 121 delkppkrqe evrqsvtpae pvqyyftlaq qptavqvggq qggqqttsst ttiqpgqiii 181 aqpqqggqttp vtmqvgeggq vgivgaqpqg qaqqaqsgtg qtmqvmqqii tntgeiggip 241 vqlnagqlqy irlaqpvsgt qvvqgqiqtl atnaqqgqrn asqgkpprrcl ketlqitqte 301 vqqgqqqfsq ftdgqqlyqi qqvtmpagqd laqpmfiqsa nqpsdgqapq vtgd
```

Nuclear transcription factor Y subunit gamma, isoform 2, NP_055038.2
(SEQ ID NO: 120)
```
  1 msteggfggt sssdaqqslq sfwprvmeei rnitvkdfry qelplarikk imkldedvkm 61 isaeapvlfa kaaqifitel tlrawihted nkrrtlqrnd iamaitkfdq fdflidivpr 121 delkppkrqe evrqsvtpae pvqyyftlaq qptavqvggq qggqqttsst ttiqpgqiii
```

```
181 aqpqqgqttp vtmqvgeggq vgivgaqpqg qaqqaqsgtg qtmqvmqqii tntgeiggip 241 vqlnagglqy irlaqpvsgt qvvqgqiqtl atnaggitqt evqqgqqqfs qftdgqqlyq 301 iqqvtmpagq dlaqpmfigs anqpsdgqap qvtgd
```

Nuclear transcription factor Y subunit gamma, isoform 3,
NP_001136059.1
                                                           (SEQ ID NO: 121)
```
  1 msteggfggt sssdaqqslq sfwprvmeei rnitvkdfry qelplarikk imkldedvkm 61 isaeapvlfa kaaqifitel tlrawihted nkrrtlqrnd iamaitkfdq fdflidivpr 121 delkppkrqe evrqsvtpae pvqyyftlaq qptavqvggq qqgqttsst ttiqpgqiii 181 aqpqqgqttp vtmqvgeggq vgivgaqpqg qaqqaqsgtg qtmqvmqqii tntgeiqqip 241 vqlnagglqy irlaqpvsgt qvvqgqiqtl atnaggitqt evqqgqqqfs qftdgglyqi 301 qqvtmpagqd laqpmfiqsa nqpsdgqapq vtgd
```

Nuclear transcription factor Y subunit gamma, isoform 4,
NP_001136061.1
                                                           (SEQ ID NO: 122)
```
  1 msteggfggt sssdaqqslq sfwprvmeei rnitvkdfry qelplarikk imkldedvkr 61 ndiamaitkf dqfdflidiv prdelkppkr geevrqsvtp aepvqyyftl aqqptavqvg 121 gqqqgqtts stttiqpgqi iiaqpqqgqt tpvtmqvgeg qqvgivgaqp qgqaqqaqsg 181 tgqtmqvmqq iitntgeigq ipvqlnagql gyirlaqpvs gtqvvqgqiq tlatnaggit 241 qtevqqgqqq fsqftdgqql ygiqqvtmpa gqdlaqpmfi qsanqpsdgq apqvtgd
```

Nuclear transcription factor Y subunit gamma, isoform 5,
NP_001136062.1
                                                           (SEQ ID NO: 123)
```
  1 msteggfggt sssdaqqslq sfwprvmeei rnitvkdfry qelplarikk imkldedvkm 61 isaeapvlfa kaaqifitel tlrawihted nkrrtlqrnd iamaitkfdq fdflidivpr 121 delkppkrqe evrqsvtpae pvqyyftlaq qptavqvggq qqgqttsst ttiqpgqiii 181 aqpqqgqtmq vmqqiitntg eiggipvqln agglgyirla qpvsgtqvvg gqiqtlatna 241 qgitqtevqq gqqqfsqftd gqqlyqiqqv tmpagqdlaq pmfiqsanqp sdgqapqvtg 301 d
```

Nuclear transcription factor Y subunit gamma, isoform 6,
NP_001295043.1
                                                           (SEQ ID NO: 124)
```
  1 msteggfggt sssdaqqslq sfwprvmeei rnitvkdfry qelplarikk imkldedvkm 61 isaeapvlfa kaaqifitel tlrawihted nkrrtlqrnd iamaitkfdq fdflidivpr 121 delkppkrqe evrqsvtpae pvqyyftlaq qptavqvggq qqgqttsst ttiqpgqiii 181 aqpqqgqttp vtmqvgeggq vgivgaqpqg qaqqaqsgtg qtmqvmqqii tntgeiggip 241 vqlnagglqy irlaqpvsgt qvvqgqiqtl atnaqqgqrn asqgkprrcl ketlqitqte 301 vqqgqqqfsq ftdgqrnsvg qarvseltge aeprevkatg nstpctsslp tthppshrag 361 ascvccsqpq qsstspppsd alqwvvvevs gtpnglethr elhaplpgmt slsplhpsqq 421 lyqiqqvtmp agqdlaqpmf iqsanqpsdg qapqvtgd
```

Nuclear transcription factor Y subunit gamma, isoform 7,
NP_001295044.1
                                                           (SEQ ID NO: 125)
```
  1 msteggfggt sssdaqqslq sfwprvmeei rnitvkdfry qelplarikk imkldedvkm 61 isaeapvlfa kaaqifitel tlrawihted nkrrtlqrnd iamaitkfdq fdflidivpr 121 delkppkrqe evrqsvtpae pvqyyftlaq qptavqvggq qqgqttsst ttiqpgqiii 181 aqpqqgqttp vtmqvgeggq vgivgaqpqg qaqqaqsgtg qtmqvmqqii tntgeiggip 241 vqlnagglqy irlaqpvsgt qvvqgqiqtl atnaggitqt evqqgqqqfs qftdgqrnsv
```

```
301 qqarvseltg eaeprevkat gnstpctssl ptthppshra gascvccsqp qqsstsppps 361 dalqwvvvev sgtpngleth relhaplpgm tslsplhpsq glyqiqqvtm pagqdlaqpm 421 fiqsanqpsd gqapqvtgd
```

NFKB repressing factor, isoform 1, NP_001166958.1
(SEQ ID NO: 126)

```
  1 mgfmlplifr ysprlmekil qmaegidige mpsydlvlsk pskgqkrhls tcdgqnppkk 61 qagskfharp rfepvhfvas sskderqedp ygpqtkevne qthfasmprd iygdytqdsf 121 siqdgnsqyc dssgfiltkd qpvtanmyfd sgnpapstts qqansgstpe pspsqtfpes 181 vvaekqyfie kltatiwknl snpemtsgsd kinytymltr ciqacktnpe yiyaplkeip 241 padipknkkl ltdgyacevr cqniylttgy agskngsrdr atelavkllq krievrvvrr 301 kfkhtfgedl vvcqigmssy efppalkppe dlvvlgkdas gqpifnasak hwtnfviten 361 andaigilnn sasfnkmsie ykyemmpnrt wrcrvflqdh claegygtkk tskhaaadea 421 lkilqktqpt ypsvkssqch tgssprgsgk kkdikdlvvy enssnpvctl ndtaqfnrmt 481 veyvyermtg lrwkckvile seviaeavgv kktvkyeaag eavktlkktq ptvinnlkkg 541 avedvisrne iggrsaeeay kqqikednig nqllrkmgwt ggglgksgeg irepisvkeq 601 hkreglgldv ervnkiakrd ieqiirnyar seshtdltfs reltnderkq ihqiaqkygl 661 kskshgvghd rylvvgrkrr kedlldqlkq egqvghyelv mpqan
```

NFKB repressing factor, isoform 2, NP_001166959.1, NP_060014.2
(SEQ ID NO: 127)

```
  1 mekilqmaeg idigempsyd lvlskpskgq krhlstcdgq nppkkgagsk fharprfepv 61 hfvassskde rqedpygpqt kevnegthfa smprdiyqdy tqdsfsiqdg nsqycdssgf 121 iltkdqpvta nmyfdsgnpa psttsqqans qstpepspsq tfpesvvaek qyfiekltat 181 iwknlsnpem tsgsdkinyt ymltrciqac ktnpeyiyap lkeippadip knklltdgy 241 acevrcqniy lttgyagskn gsrdratela vkllqkriev rvvrrkfkht fgedlvvcqi 301 gmssyefppa lkppedlvvl gkdasgqpif nasakhwtnf vitenandai gilnnsasfn 361 kmsieykyem mpnrtwrcry flqdhclaeg ygtkktskha aadealkilq ktqptypsvk 421 ssqchtgssp rgsgkkkdik dlvvyenssn pvctlndtaq fnrmtveyvy ermtglrwkc 481 kvilesevia eavgvkktvk yeaageavkt lkktqptvin nlkkgavedv isrneiggrs 541 aeeaykqqik ednignqllr kmgwtggglg ksgegirepi svkeqhkreg lgldvervnk 601 iakrdieqii rnyarsesht dltfsreltn derkqihqia qkyglksksh gvghdrylvv 661 grkrrkedll dqlkqegqvg hyelvmpqan
```

Plasminogen activator, urokinase, urokinase-type plasminogen
activator isoform 1 preproprotein, NP_002649.1
(SEQ ID NO: 128)

```
  1 mrallarlll cvlvvsdskg snelhqvpsn cdclnggtcv snkyfsnihw cncpkkfggq 61 hceidksktc yegnghfyrg kastdtmgrp clpwnsatvl qqtyhahrsd alqlglgkhn 121 ycrnpdnrrr pwcyvqvglk plvqecmvhd cadgkkpssp peelkfqcgq ktlrprfkii 181 ggefttienq pwfaaiyrrh rggsvtyvcg gslispcwvi sathcfidyp kkedyivylg 241 rsrinsntqg emkfevenli lhkdysadtl ahhndiallk irskegrcaq psrtiqticl 301 psmyndpqfg tsceitgfgk enstdylype qlkmtvvkli shrecqqphy ygsevttkml 361 caadpqwktd scqgdsggpl vcslqgrmtl tgivswgrgc alkdkpgvyt rvshflpwir 421 shtkeengla l
```

Plasminogen activator, urokinase, urokinase-type plasminogen
activator isoform 2, NP_001138503.1
(SEQ ID NO: 129)

```
  1 mvfhlrtrye gancdclngg tcvsnkyfsn ihwcncpkkf ggqhceidks ktcyegnghf
```

```
 61 yrgkastdtm grpclpwnsa tvlqqtyhah rsdalqlglg khnycrnpdn rrrpwcyvqv 121 glkplvqecm vhdcadgkkp ssppeelkfq cgqktlrprf kiiggeftti enqpwfaaiy 181 rrhrggsvty vcggslispc wvisathcfi dypkkedyiv ylgrsrinsn tqgemkfeve 241 nlilhkdysa dtlahhndia llkirskegr caqpsrtiqt iclpsmyndp qfgtsceitg 301 fgkenstdyl ypeqlkmtvv klishrecqq phyygsevtt kmlcaadpqw ktdscqgdsg 361 gplvcslqgr mtltgivswg rgcalkdkpg vytrvshflp wirshtkeen glal
```

Plasminogen activator, urokinase, urokinase-type plasminogen
activator isoform 3, NP_001306120.1
(SEQ ID NO: 130)

```
  1 mgrpclpwns atvlqqtyha hrsdalqlgl gkhnycrnpd nrrrpwcyvq vglkplvqec 61 mvhdcadgkk pssppeelkf qcgqktlrpr fkiiggeftt ienqpwfaai yrrhrggsvt 121 yvcggslisp cwvisathcf idypkkedyi vylgrsrins ntqgemkfev enlilhkdys 181 adtlahhndi allkirskeg rcaqpsrtiq ticlpsmynd pqfgtsceit gfgkenstdy 241 lypeqlkmtv vklishrecq qphyygsevt tkmlcaadpq wktdscqgds ggplvcslqg 301 rmtltgivsw grgcalkdkp gvytrvshfl pwirshtkee nglal
```

Receptor tyrosine kinase like orphan receptor 1, inactive tyrosine-
protein kinase transmembrane receptor ROR1 isoform 1 precursor,
NP_005003.2
(SEQ ID NO: 131)

```
  1 mhrprrrgtr ppllallaal llaargaaaq etelsysael vptsswniss elnkdsyltl 61 depmnnitts lgqtaelhck vsgnppptir wfkndapvvq eprrlsfrst iygsrlrirn 121 ldttdtgyfq cvatngkevv sstgvlfvkf gppptaspgy sdeyeedgfc qpyrgiacar 181 fignrtvyme slhmqgeien qitaaftmig tsshlsdkcs qfaipslchy afpycdetss 241 vpkprdlcrd eceilenvlc qteyifarsn pmilmrlklp ncedlpqpes peaancirig 301 ipmadpinkn hkcynstgvd yrgtvsvtks grqcqpwnsq yphthtftal rfpelngghs 361 ycrnpgnqke apwcftlden fksdlcdipa cdskdskekn kmeilyilvp svaiplaial 421 lffficvcrn nqksssapvq rqpkhvrgqn vemsmlnayk pkskakelpl savrfmeelg 481 ecafgkiykg hlylpgmdha qlvaiktlkd ynnpqqwtef qqeaslmael hhpnivcllg 541 avtqegpvcm lfeyinqgdl heflimrsph sdvgcssded gtvkssldhg dflhiaigia 601 agmeylsshf fvhkdlaarn iligeqlhvk isdlglsrei ysadyyrvqs ksllpirwmp 661 peaimygkfs sdsdiwsfgv vlweifsfgl qpyygfsnqe viemvrkrql lpcsedcppr 721 myslmtecwn eipsrrprfk dihvrlrswe glsshtsstt psggnattqt tslsaspvsn 781 lsnprypnym fpsqgitpqg qiagfigppi pqnqrfipin gypippgyaa fpaahygptg 841 pprviqhcpp pksrspssas gststghvts lpssgsnqea nipllphmsi pnhpggmgit 901 vfgnksqkpy kidskqasll gdanihghte smisael
```

Receptor tyrosine kinase like orphan receptor 1, inactive tyrosine-
protein kinase transmembrane receptor ROR1 isoform 2 precursor,
NP_001077061.1
(SEQ ID NO: 132)

```
  1 mhrprrrgtr ppllallaal llaargaaaq etelsysael vptsswniss elnkdsyltl 61 depmnnitts lgqtaelhck vsgnppptir wfkndapvvq eprrlsfrst iygsrlrirn 121 ldttdtgyfq cvatngkevv sstgvlfvkf gppptaspgy sdeyeedgfc qpyrgiacar 181 fignrtvyme slhmqgeien qitaaftmig tsshlsdkcs qfaipslchy afpycdetss 241 vpkprdlcrd eceilenvlc qteyifarsn pmilmrlklp ncedlpqpes peaancirig 301 ipmadpinkn hkcynstgvd yrgtvsvtks grqcqpwnsq yphthtftal rfpelngghs 361 ycrnpgnqke apwcftlden fksdlcdipa cgk
```

```
Runt related transcription factor 1, runt-related transcription
factor 1 isoform AML1a, NP_001116079.1
                                                    (SEQ ID NO: 133)
   1 mripvdasts rrftppstal spgkmsealp lgapdagaal agklrsgdrs mvevladhpg 61 elvrtdspnf lcsvlpthwr cnktlpiafk vvalgdvpdg tivtvmagnd enysaelrna 121 taamknqvar fndlrfvgrs grgksftlti tvftnppqva tyhraikitv dgpreprrhr 181 qklddqtkpg slsfserlse leqlrrtamr vsphhpaptp npraslnhst afnpqpqsqm 241 qeedtapwrc
Runt related transcription factor 1, runt-related transcription
factor 1 isoform AML1b, NP_001001890.1
                                                    (SEQ ID NO: 134)
   1 mripvdasts rrftppstal spgkmsealp lgapdagaal agklrsgdrs mvevladhpg 61 elvrtdspnf lcsvlpthwr cnktlpiafk vvalgdvpdg tivtvmagnd enysaelrna 121 taamknqvar fndlrfvgrs grgksftlti tvftnppqva tyhraikitv dgpreprrhr 181 qklddqtkpg slsfserlse leqlrrtamr vsphhpaptp npraslnhst afnpqpqsqm 241 qdtrqiqpsp pwsydqsyqy lgsiaspsvh patpispgra sgmttlsael ssrlstapdl 301 tafsdprqfp alpsisdprm hypgaftysp tpvtsgigig msamgsatry htylpppypg 361 ssgagggpfq asspsyhlyy gasagsyqfs mvggersppr ilppctnast gsallnpslp 421 nqsdvveaeg shsnsptnma psarleeavw rpy
Runt related transcription factor 1, runt-related transcription
factor 1 isoform AML1c, NP_001745.2
                                                    (SEQ ID NO: 135)
   1 masdsifesf psypqcfmre cilgmnpsrd vhdastsrrf tppstalspg kmsealplga 61 pdagaalagk lrsgdrsmve vladhpgelv rtdspnflcs vlpthwrcnk tlpiafkvva 121 lgdvpdgtiv tvmagndeny saelrnataa mknqvarfnd lrfvgrsgrg ksftltitvf 181 tnppqvatyh raikitvdgp reprrhrqkl ddqtkpgsls fserlseleq lrrtamrvsp 241 hhpaptpnpr aslnhstafn pqpqsqmqdt rqiqpsppws ydqsyqylgs iaspsvhpat 301 pispgrasgm ttlsaelssr lstapdltaf sdprqfpalp sisdprmhyp gaftysptpv 361 tsgigigmsa mgsatryhty lpppypgssq agggpfgass psyhlyygas agsyqfsmvg 421 gersppriIp pctnastgsa llnpslpnqs dvveaegshs nsptnmapsa rleeavwrpy
Surfactant protein A1, pulmonary surfactant-associated protein A1
isoform 1 precursor, NP_001158116.1, NP_001158119.1, NP_005402.3
                                                    (SEQ ID NO: 136)
   1 mwlcplalnl ilmaasgavc evkdvcvgsp gipgtpgshg lpgrdgrdgl kgdpgppgpm 61 gppgempcpp gndglpgapg ipgecgekge pgergppglp ahldeelqat lhdfrhqilq 121 trgalslqgs imtvgekvfs sngqsitfda iqeacaragg riavprnpee neaiasfvkk 181 yntyayvglt egpspgdfry sdgtpvnytn wyrgepagrg keqcvemytd gqwndrncly 241 srlticef
Surfactant protein A1, pulmonary surfactant-associated protein A1
isoform 2 precursor, NP_001087239.2
                                                    (SEQ ID NO: 137)
   1 mrpcqvpgaa tgpramwlcp lalnlilmaa sgavcevkdv cvgspgipgt pgshglpgrd 61 grdglkgdpg ppgpmgppge mpcppgndgl pgapgipgec gekgepgerg ppglpahlde 121 elqatlhdfr hqilqtrgal slqgsimtvg ekvfssngqs itfdaiqeac araggriavp 181 rnpeeneaia sfvkkyntya yvgltegpsp gdfrysdgtp vnytnwyrge pagrgkeqcv 241 emytdgqwnd rnclysrlti cef
```

-continued

Surfactant protein A1, pulmonary surfactant-associated protein A1
isoform 3 precursor, NP_001158117.1
(SEQ ID NO: 138)

```
  1 mrpcqvpgaa tgpramwlcp lalnlilmaa sgavcevkdv cvgtpgipge cgekgepger 61 gppglpahld eelqatlhdf rhqilqtrga lslqgsimtv gekvfssngq sitfdaiqea 121 caraggriav prnpeeneai asfvkkynty ayvgltegps pgdfrysdgt pvnytnwyrg 181 epagrgkeqc vemytdgqwn drnclysrlt icef
```

Surfactant protein A1, pulmonary surfactant-associated protein A1
isoform 4 precursor, NP_001158118.1
(SEQ ID NO: 139)

```
  1 mwlcplalnl ilmaasgavc evkdvcvgtp gipgecgekg epgergppgl pahldeelqa 61 tlhdfrhqil qtrgalslqg simtvgekvf ssngqsitfd aiqeacarag griavprnpe 121 eneaiasfvk kyntyayvgl tegpspgdfr ysdgtpvnyt nwyrgepagr gkeqcvemyt 181 dgqwndrncl ysrlticef
```

Surfactant protein A2, pulmonary surfactant-associated protein A2
isoform 1 precursor, NP_001092138.1, NP_001307742.1
(SEQ ID NO: 140)

```
  1 mwlcplaltl ilmaasgaac evkdvcvgsp gipgtpgshg lpgrdgrdgv kgdpgppgpm 61 gppgetpcpp gnnglpgapg vpgergekge agergppglp ahldeelqat lhdfrhqilq 121 trgalslqgs imtvgekvfs sngqsitfda iqeacaragg riavprnpee neaiasfvkk 181 yntyayvglt egpspgdfry sdgtpvnytn wyrgepagrg keqcvemytd gqwndrncly 241 srlticef
```

Surfactant protein A2, pulmonary surfactant-associated protein A2
isoform 2 precursor, NP_001307743.1
(SEQ ID NO: 141)

```
  1 mpgaatgpra mwlcplaltl ilmaasgaac evkdvcvgsp gipgtpgshg lpgrdgrdgv 61 kgdpgppgpm gppgetpcpp gnnglpgapg vpgergekge agergppglp ahldeelqat 121 lhdfrhqilq trgalslqgs imtvgekvfs sngqsitfda iqeacaragg riavprnpee 181 neaiasfvkk yntyayvglt egpspgdfry sdgtpvnytn wyrgepagrg keqcvemytd 241 gqwndrncly srlticef
```

Surfactant protein B, pulmonary surfactant-associated protein B
precursor, NP_000533.3, NP_942140.2
(SEQ ID NO: 142)

```
  1 mhqagypgcr gamaeshllq wlllllptic gpgtaawtts slacaqgpef wcgslegalq 61 cralghclqe vwghvgaddl cqecedivhi lnkmakeaif qdtmrkfleq ecnvlplkll 121 mpqcnqvldd yfplvidyfq nqtdsngicm hlglcksrqp epeqepgmsd plpkplrdpl 181 pdplldklvl pvlpgalgar pgphtqdlse qqfpiplpyc wlcralikri qamipkgala 241 vavaqvcrvv plvaggicqc laerysvill dtllgrmlpq lvcrlvlrcs mddsagprsp 301 tgewlprdse chlcmsvttq agnsseqaip qamlqacvgs wldrekckqf veghtpqllt 361 lvprgwdaht tcgalgvcgt mssplqcihs pdl
```

Surfactant protein C, pulmonary surfactant-associated protein C
isoform 1 precursor, NP_001165881.1, NP_003009.2
(SEQ ID NO: 143)

```
  1 mdvgskevlm esppdysaap rgrfgipccp vhlkrllivv vvvvlivvvi vgallmglhm 61 sqkhtemvle msigapeagq rlalsehlvt tatfsigstg lvvydyqqll iaykpapgtc 121 cyimkiapes ipslealtrk vhnfqmecsl qakpavptsk lgqaegrdag sapsggdpaf 181 lgmaysticg evplyyi
```

Surfactant protein C, pulmonary surfactant-associated protein C
isoform 2 precursor, NP_001165828.1, NP_001304707.1, NP_001304709.1
(SEQ ID NO: 144)

```
  1 mdvgskevlm esppdysaap rgrfgipccp vhlkrllivv vvvvlivvvi vgallmglhm
```

-continued

```
    61 sqkhtemvle msigapeagq rlalsehlvt tatfsigstg lvvydyqqll iaykpapgtc 121 cyimkiapes ipslealtrk vhnfqakpav ptsklgqaeg rdagsapsgg dpaflgmays 181 tlcgevplyy i
```

Surfactant protein C, pulmonary surfactant-associated protein C
isoform 3 precursor, NP_001304708.1
(SEQ ID NO: 145)

```
     1 mdvgskevlm esppvlemsi gapeaqqrla lsehlvttat fsigstglvv ydygglliay 61 kpapgtccyi mkiapesips lealtrkvhn fqmecslqak pavptsklgq aegrdagsap 121 sggdpaflgm aysticgevp lyyi
```

Surfactant protein D, pulmonary surfactant-associated protein D
precursor, NP_003010.4
(SEQ ID NO: 146)

```
     1 mllfllsalv lltqplgyle aemktyshrt mpsactivmc ssvesglpgr dgrdgregpr 61 gekgdpglpg aagqagmpgq agpvgpkgdn gsvgepgpkg dtgpsgppgp pgvpgpagre 121 gplgkqgnig pqgkpgpkge agpkgevgap gmqgsagarg lagpkgergv pgergvpgnt 181 gaagsagamg pqgspgargp pglkgdkgip gdkgakgesg lpdvaslrqg vealqgqvqh 241 lqaafsqykk velfpngqsv gekifktagf vkpfteaqll ctgagggglas prsaaenaal 301 qqlvvaknea aflsmtdskt egkftyptge slvysnwapg epnddggsed cveiftngkw 361 ndracgekrl vvcef
```

Solute carrier family 2 member 5, solute carrier family 2,
facilitated glucose transporter member 5 isoform 1,
NP_001315548.1, NP_003030.1
(SEQ ID NO: 147)

```
     1 meqqdqsmke grltivlala tliaafgssf qygynvaavn spallmqqfy netyygrtge 61 fmedfpltll wsvtvsmfpf ggfigsllvg plvnkfgrkg allfnnifsi vpailmgcsr 121 vatsfeliii srllvgicag vssnvvpmyl gelapknlrg algvvpqlfi tvgilvaqif 181 glrnllanvd gwpillgltg vpaalqllll pffpespryl liqkkdeaaa kkalqtlrgw 241 dsvdrevaei rqedeaekaa gfisvlklfr mrslrwqlls iivlmggqql sgvnaiyyya 301 dqiylsagvp eehvqyvtag tgavnvvmtf cavfvvellg rrllllllgfs icliaccvlt 361 aalalqdtvs wmpyisivcv isyvighalg pspipallit eiflqssrps afmvggsvhw 421 lsnftvglif pfigeglgpy sfivfavicl lttiyifliv petkaktfie inqiftkmnk 481 vsevypekee lkelppvtse q
```

Solute carrier family 2 member 5, solute carrier family 2,
facilitated glucose transporter member 5 isoform 2,
NP_001129057.1
(SEQ ID NO: 148)

```
     1 meqqdqsmke grltivlala tliaafgssf qygynvaavn spallmqqfy netyygrtge 61 fmedfpltll wsvtvsmfpf ggfigsllvg plvnkfgrkg allfnnifsi vpailmgcsr 121 vatsfeliii srllvgicag vssnvvpmyl gelapknlrg algvvpqlfi tvgilvaqif 181 glrnllanvd gefrtsrehp hpftttlgpl lvfqshhhrt glsadwsllt gwmslggpsc 241 pept
```

Solute carrier family 2 member 5, solute carrier family 2,
facilitated glucose transporter member 5 isoform 3,
NP_001315549.1
(SEQ ID NO: 149)

```
     1 mgttwllstp qhwtgefmed fpltllwsvt vsmfpfggfi gsllvgplvn kfgrkgallf 61 nnifsivpai lmgcsrvats feliiisrll vgicagvssn vvpmylgela pknlrgalgv 121 vpqlfitvgi lvaqifglrn llanvdgwpi llgltgvpaa lqllllpffp espryllliqk 181 kdeaaakkal qtlrgwdsvd revaeirqed eaekaagfis vlklfrmrsl rwqllsiivl
```

```
241 mggqqlsgvn aiyyyadqiy lsagvpeehv qyvtagtgav nvvmtfcavf vvellgrrll 301 lllgfsicli accvltaala lqdtvswmpy isivcvisyv ighalgpspi palliteifl 361 qssrpsafmv ggsvhwlsnf tvglifpfiq eglgpysfiv faviclltti yiflivpetk 421 aktfieinqi ftkmnkvsev ypekeelkel ppvtseq
```

Solute carrier family 2 member 5, solute carrier family 2, facilitated glucose transporter member 5 isoform 4, NP_001315550.1

(SEQ ID NO: 150)

```
  1 mylgelapkn lrgalgvvpq lfitvgilva qifglrnlla nvdgwpillg ltgvpaalql 61 lllpffpesp rylliqkkde aaakkalgtl rgwdsvdrev aeirqedeae kaagfisvlk 121 lfrmrslrwq llsiivlmgg qqlsgvnaiy yyadqiylsa gvpeehvgyv tagtgavnvv 181 mtfcavfvve llgrrlllll gfsicliacc vltaalalqd tvswmpyisi vcvisyvigh 241 algpspipal liteiflqss rpsafmvggs vhwlsnftvg lifpfigegl gpysfivfav 301 iclltttiyif livpetkakt fieinqiftk mnkvsevype keelkelppv tseq
```

Sperm associated antigen 9, C-Jun-amino-terminal kinase-interacting protein 4 isoform 1, NP_001124000.1

(SEQ ID NO: 151)

```
   1 meledgvvyq eepggsgavm servsglags iyreferlig rydeevvkel mplvvavlen 61 ldsvfaqdqe hqvelellrd dneglitgye rekalrkhae ekfiefedsq eqekkdlqtr 121 veslesqtrq lelkaknyad qisrleerea elkkeynalh qrhtemihny mehlertklh 181 qlsgsdqles tahsrirker pislgifplp agdglltpda qkggetpgse qwkfgelsqp 241 rshtslkvsn spepqkaveq edelsdvsqg gskattpast ansdvatipt dtplkeeneg 301 fvkvtdapnk seiskhievq vagetrnvst gsaeneekse vqaiiestpe ldmdkdlsgy 361 kgsstptkgi enkafdrnte slfeelssag sgligdvdeg adllgmgrev enlilentql 421 letknalniv kndliakvde ltcekdvlqg eleavkqakl kleeknrele eelrkaraea 481 edarqkakdd ddsdiptaqr krftrvemar vlmernqyke rlmelqeavr wtemirasre 541 npamqekkrs siwqffsrlf ssssnttkkp eppvnlkyna ptshvtpsvk krsstlsqlp 601 gdkskafdfl seeteaslas rregkregyr qvkahvgked grvgafgwsl pqkykqvtng 661 qgenkmknlp vpvylrplde kdtsmklwca vgvnlsggkt rdggsvvgas vfykdvagld 721 tegskqrsas gssldkldge lkeqqkelkn geelsslvwi ctsthsatkv liidavqpgn 781 ildsftvcns hvlciasvpg aretdypage dlsesgqvdk aslcgsmtsn ssaetdsllg 841 gitvvgcsae gvtgaatsps tngaspvmdk ppemeaense vdenvptaee ateategnag 901 saedtvdisq tgvytehvft dplgvqiped lspvyqssnd sdaykdqisv lpneqdlvre 961 eaqkmssllp tmwlgagngc lyvhssvaqw rkclhsiklk dsilsivhvk givlvaladg 1021 tlaifhrgvd gqwdlsnyhl ldlgrphhsi rcmtvvhdkv wcgyrnkiyv vqpkamkiek 1081 sfdahprkes qvrqlawvgd gvwvsirlds tlrlyhahty qhlqdvdiep yvskmlgtgk 1141 lgfsfvrita lmvscnrlwv gtgngviisi pltetnktsg vpgnrpgsvi rvygdensdk 1201 vtpgtfipyc smahaqlcfh ghrdavkffv avpgqvispq ssssgtdltg dkagpsaqep 1261 gsqtplksml visggegyid frmgdegges ellgedlple psvtkaersh livwqvmygn 1321 e
```

Sperm associated antigen 9, C-Jun-amino-terminal kinase-interacting protein 4 isoform 2, NP_001123999.1

(SEQ ID NO: 152)

```
  1 meledgvvyq eepggsgavm servsglags iyreferlig rydeevvkel mplvvavlen 61 ldsvfaqdqe hqvelellrd dneglitgye rekalrkhae ekfiefedsq eqekkdlqtr 121 veslesqtrq lelkaknyad qisrleerea elkkeynalh qrhtemihny mehlertklh
```

-continued

```
 181 qlsgsdqles tahsrirker pislgifplp agdglltpda qkggetpgse qwkfgelsqp
 241 rshtslkdel sdvsqggska ttpastansd vatiptdtpl keenegfvkv tdapnkseis
 301 khievqvaqe trnvstgsae neeksevqai iestpeldmd kdlsgykgss tptkgienka
 361 fdrnteslfe elssagsgli gdvdegadll gmgrevenli lentqlletk nalnivkndl
 421 iakvdeltce kdvlqgelea vkqaklklee knreleeelr karaeaedar qkakddddsd
 481 iptaqrkrft rvemarvlme rnqykerlme lqeavrwtem irasrenpam gekkrssiwq
 541 fvptrfsrlf ssssnttkkp eppvnlkyna ptshvtpsvk krsstlsqlp gdkskafdfl
 601 seeteaslas rregkregyr qvkahvgked grvgafgwsl pqkykqvtng qgenkmknlp
 661 vpvylrplde kdtsmklwca vgvnlsggkt rdggsvvgas vfykdvagld tegskqrsas
 721 qssldkldge lkeqqkelkn geelsslvwi ctsthsatkv liidavqpgn ildsftvcns
 781 hvlciasvpg aretdypage dlsesgqvdk aslcgsmtsn ssaetdsllg gitvvgcsae
 841 gvtgaatsps tngaspvmdk ppemeaense vdenvptaee ateategnag saedtvdisq
 901 tgvytehvft dplgvqiped lspvyqssnd sdaykdqisv lpneqdlvre eaqkmssllp
 961 tmwlgaqngc lyvhssvaqw rkclhsiklk dsilsivhvk givlvaladg tlaifhrgvd
1021 gqwdlsnyhl ldlgrphhsi rcmtvvhdkv wcgyrnkiyv vqpkamkiek sfdahprkes
1081 qvrqlawvgd gvwvsirlds tlrlyhahty qhlqdvdiep yvskmlgtgk lgfsfvrita
1141 lmvscnrlwv gtgngviisi pltetnktsg vpgnrpgsvi rvygdensdk vtpgtfipyc
1201 smahaqlcfh ghrdavkffv avpgqvispq ssssgtdltg dkagpsaqep gsqtplksml
1261 visggegyid frmgdegges ellgedlple psvtkaersh livwqvmygn e
```

Sperm associated antigen 9, C-Jun-amino-terminal kinase-interacting protein 4 isoform 3, NP_003962.3

(SEQ ID NO: 153)

```
   1 meledgvvyq eepggsgavm servsglags iyreferlig rydeevvkel mplvvavlen
  61 ldsvfaqdge hqvelellrd dneglitgye rekalrkhae ekfiefedsq eqekkdlqtr
 121 veslesqtrq lelkaknyad qisrleerea elkkeynalh qrhtemihny mehlertklh
 181 qlsgsdqles tahsrirker pislgifplp agdglltpda qkggetpgse qwkfgelsqp
 241 rshtslkdel sdvsqggska ttpastansd vatiptdtpl keenegfvkv tdapnkseis
 301 khievqvaqe trnvstgsae neeksevqai iestpeldmd kdlsgykgss tptkgienka
 361 fdrnteslfe elssagsgli gdvdegadll gmgrevenli lentqlletk nalnivkndl
 421 iakvdeltce kdvlqgelea vkqaklklee knreleeelr karaeaedar qkakddddsd
 481 iptaqrkrft rvemarvlme rnqykerlme lqeavrwtem irasrenpam gekkrssiwq
 541 ffsrlfssss nttkkpeppv nlkynaptsh vtpsvkkrss tlsqlpgdks kafdflseet
 601 easlasrreq kreqyrqvka hvgkedgrvg afgwslpqky kqvtngqgen kmknlpvpvy
 661 lrpldekdts mklwcavgvn lsggktrdgg svvgasvfyk dvagldtegs kqrsasgssl
 721 dkldqelkeq gkelkngeel sslvwictst hsatkvliid avqpgnilds ftvcnshvlc
 781 iasvpgaret dypagedlse sgqvdkaslc gsmtsnssae tdsllggitv vgcsaegvtg
 841 aatspstnga spvmdkppem eaensevden vptaeeatea tegnagsaed tvdisqtgvy
 901 tehvftdplg vqipedlspv yqssndsday kqgisvlpne qdlvreeaqk mssllptmwl
 961 gaqngclyvh ssvaqwrkcl hsiklkdsil sivhvkgivl valadgtlai fhrgvdgqwd
1021 lsnyhlldlg rphhsircmt vvhdkvwcgy rnkiyvvqpk amkieksfda hprkesqvrq
1081 lawvgdgvwv sirldstlrl yhahtyghlq dvdiepyvsk mlgtgklgfs fvritalmvs
1141 cnrlwvgtgn gviisiplte tnktsgvpgn rpgsvirvyg densdkvtpg tfipycsmah
```

```
1201 aqlcfhghrd avkffvavpg qvispqssss gtdltgdkag psagepgsgt plksmlvisg 1261 gegyidfrmg deggesellg edlplepsvt kaershlivw qvmygne
```

Sperm associated antigen 9, C-Jun-amino-terminal kinase-interacting
protein 4 isoform 4, NP_001238900.1

(SEQ ID NO: 154)

```
   1 mspgcmllfv fgfvggavvi nsailvslsv lllvhfsist gvpaltqnlp rilrkerpis 61 lgifplpagd glltpdaqkg getpgseqwk fgelsqprsh tslkdelsdv sqggskattp 121 astansdvat iptdtplkee negfvkvtda pnkseiskhi evqvagetrn vstgsaenee 181 ksevqaiies tpeldmdkdl sgykgsstpt kgienkafdr nteslfeels sagsgligdv 241 degadllgmg revenlilen tqlletknal nivkndliak vdeltcekdv lggeleavkg 301 aklkleeknr eleeelrkar aeaedarqka kddddsdipt aqrkrftrve marvlmernq 361 ykerlmelqe avrwtemira srenpamgek krssiwqffs rlfssssntt kkpeppvnlk 421 ynaptshvtp svkkrsstls qlpgdkskaf dflseeteas lasrreqkre gyrqvkahvg 481 kedgrvqafg wslpqkykqv tngqgenkmk nlpvpvylrp ldekdtsmkl wcavgvnlsg 541 gktrdggsvv gasvfykdva gldtegskqr sasgssldkl dgelkeggke lkngeelssl 601 vwictsthsa tkvliidavq pgnildsftv cnshvlcias vpgaretdyp agedlsesgq 661 vdkaslcgsm tsnssaetds llggitvvgc saegvtgaat spstngaspv mdkppemeae 721 nsevdenvpt aeeateateg nagsaedtvd isqtgvyteh vftdplgvqi pedlspvyqs 781 sndsdaykdq isvlpneqdl vreeaqkmss llptmwlgaq ngclyvhssv aqwrkclhsi 841 klkdsilsiv hvkgivlval adgtlaifhr gvdgqwdlsn yhlldlgrph hsircmtvvh 901 dkvwcgyrnk iyvvqpkamk ieksfdahpr kesqvrqlaw vgdgvwvsir ldstlrlyha 961 htyqhlqdvd iepyvskmlg tgklgfsfvr italmvscnr lwvgtgngvi isipltetvi 1021 lhqgrllglr anktsgvpgn rpgsvirvyg densdkvtpg tfipycsmah aqlcfhghrd 1081 avkffvavpg qvispqssss gtdltgdkag psagepgsgt plksmlvisg gegyidfrmg 1141 deggesellg edlplepsvt kaershlivw qvmygne
```

SGT1 homolog, MIS12 kinetochore complex assembly cochaperone,
protein SGT1 homolog isoform A, NP_006695.1

(SEQ ID NO: 155)

```
   1 maaaaagtat sqrffqsfsd alidedpqaa leeltkaleq kpddaqyycq raychillgn 61 ycvavadakk slelnpnnst amlrkgicey heknyaaale tftegqklds adanfsvwik 121 rcqeaqngse sevwthqski kydwyqtesq vvitlmiknv qkndvnvefs ekelsalvkl 181 psgedynlkl ellhpiipeq stfkvlstki eiklkkpeav rweklegqgd vptpkqfvad 241 vknlypsssp ytrnwdklvg eikeeeknek legdaalnrl fqqiysdgsd evkramnksf 301 mesggtvlst nwsdvgkrkv einppddmew kky
```

SGT1 homolog, MIS12 kinetochore complex assembly cochaperone,
protein SGT1 homolog isoform B, NP_001124384.1

(SEQ ID NO: 156)

```
   1 maaaaagtat sqrffqsfsd alidedpqaa leeltkaleq kpddaqyycq raychillgn 61 ycvavadakk slelnpnnst amlrkgicey heknyaaale tftegqkldi etgfhrvgqa 121 glqlltssdp paldsqsagi tgadanfsvw ikrcgeagng sesevwthqs kikydwyqte 181 sqvvitlmik nvqkndvnve fsekelsalv klpsgedynl klellhpiip eqstfkvlst 241 kieiklkkpe avrweklegq gdvptpkqfv advknlypss spytrnwdkl vgeikeeekn 301 eklegdaaln rlfqqiysdg sdevkramnk sfmesggtvl stnwsdvgkr kveinppddm 361 ewkky
```

SGT1 homolog, MIS12 kinetochore complex assembly cochaperone,
protein SGT1 homolog isoform C, NP_001307760.1

(SEQ ID NO: 157)

```
  1 mlsqkevava dakkslelnp nnstamlrkg iceyheknya aaletftegq kldsadanfs 61 vwikrcqeaq ngsesevwth gskikydwyq tesqvvitlm iknvqkndvn vefsekelsa 121 lvklpsgedy nlklellhpi ipegstfkvl stkieiklkk peavrwekle gqgdvptpkg 181 fvadvknlyp ssspytrnwd klvgeikeee kneklegdaa lnrlfgqiys dgsdevkram 241 nksfmesggt vlstnwsdvg krkveinppd dmewkky
```

Sulfotransferase family 1C member 2, sulfotransferase 1C2 isoform
a, NP_001047.1

(SEQ ID NO: 158)

```
  1 maltsdlgkq iklkevegtl lqpatvdnws gigsfeakpd dllictypka gttwiqeivd 61 mieqngdvek cqraiighrh pfiewarppq psgvekakam psprilkthl stqllppsfw 121 ennckflyva rnakdcmvsy yhfqrmnhml pdpgtweeyf etfingkvvw gswfdhvkgw 181 wemkdrhqil flfyedikrd pkheirkvmq fmgkkvdetv ldkivqetsf ekmkenpmtn 241 rstvsksild qsissfmrkg tvgdwknhft vaqnerfdei yrrkmegtsi nfcmel
```

Sulfotransferase family 1C member 2, sulfotransferase 1C2 isoform
b, NP_789795.1

(SEQ ID NO: 159)

```
  1 maltsdlgkq iklkevegtl lqpatvdnws gigsfeakpd dllictypka gttwigeivd 61 miegngdvek cqraiighrh pfiewarppq psetgfhhva gaglkllsss nppastsqsa 121 kitdllppsf wennckflyv arnakdcmvs yyhfqrmnhm lpdpgtweey fetfingkvv 181 wgswfdhvkg wwemkdrhqi lflfyedikr dpkheirkvm qfmgkkvdet vldkivqets 241 fekmkenpmt nrstvsksil dqsissfmrk gtvgdwknhf tvagnerfde iyrrkmegts 301 infcmel
```

Transmembrane protein 52B, isoform 1, NP_694567.1

(SEQ ID NO: 160)

```
  1 mswrpqpcci ssccltttdwv hlwyiwllvv igallllcgl tslcfrcccl srggngedgg 61 pppcevtvia fdhdstlgst itslgsvfgp aarrilavah shsslgglps sldtlpgyee 121 alhmsrftva mcgqkapdlp pvpeekglpp tekestrivd swn
```

Transmembrane protein 52B, isoform 2 precursor, NP_001073283.1

(SEQ ID NO: 161)

```
  1 mgvrvhvvaa sallyfills gtrceencgn pehclttdwv hlwyiwllvv igallllcgl 61 tslcfrcccl srggngedgg pppcevtvia fdhdstlgst itslgsvfgp aarrilavah 121 shsslgqlps sldtlpgyee alhmsrftva mcgqkapdlp pvpeekglpp tekestrivd 181 swn
```

Exportin 7, NP_055839.3

(SEQ ID NO: 162)

```
  1 madhvqslaq lenlckqlye ttdtttrlqa ekalveftns pdclskcgll lergsssysq 61 llaatcltkl vsrtnnplpl eqridirnyv lnylatrpkl atfvtgalig lyaritklgw 121 fdcqkddyvf rnaitdvtrf lgdsveycii gvtilsqltn einqadtthp ltkhrkiass 181 frdsslfdif tlscnllkga sgknlnlnde sghgllmqll klthnclnfd figtstdess 241 ddlctvqipt swrsafldss tlqlffdlyh sippsfsplv lsclvgiasv rrslfnnaer 301 akflshlvdg vkrilenpqs lsdpnnyhef crllarlksn yqlgelvkve nypevirlia 361 nftvtslghw efapnsvhyl lslwqrlaas vpyvkateph mletytpevt kayitsrles 421 vhiilrdgle dpledtglvq qqldqlstig rceyektcal lvglfdqsag sygellgsas 481 aspmdiavqe grltwlvyii gaviggrvsf astdegdamd gelvcrvlql mnitdsrlaq 541 agneklelam lsffeqfrki yigdqvgkss klyrrlsevl glndetmvls vfigkiitnl
```

-continued

```
 601 kywgrcepit sktlqllndl sigyssvrkl vklsavgfml nnhtsehfsf lginngsnit 661 dmrcrttfyt algrllmvdl gededgyegf mlpltaafea vagmfstnsf negeakrtiv 721 glvrdlrgia fafnaktsfm mlfewiypsy mpilgraiel wyhdpacttp vlklmaelvh 781 nrsqrlqfdv sspngillfr etskmitmyg nriltlgevp kdqvyalklk gisicfsmlk 841 aalsgsyvnf gvfrlygdda ldnalgtfik lllsiphsdl ldypklsgsy yslllevltqd 901 hmnfiaslep hvimyilssi segltaldtm vctgccscld hivtylfkql srstkkrttp 961 lnqesdrflh imqqhpemiq qmlstvinii ifedcrnqws msrpllglil lnekyfsdlr 1021 nsivnsqppe kqqamhlcfe nlmegiernl ltknrdrftq nlsafrrevn dsmknstygv 1081 nsndmms
```

YES proto-oncogene 1, Src family tyrosine kinase, tyrosine-protein kinase Yes, NP_005424.1
(SEQ ID NO: 163)
```
  1 mgcikskenk spaikyrpen tpepvstsys hygaepttvs pcpsssakgt avnfsslsmt 61 pfggssgvtp fggasssfsv vpssypaglt ggvtifvaly dyearttedl sfkkgerfqi 121 inntegdwwe arsiatgkng yipsnyvapa dsiqaeewyf gkmgrkdaer lllnpgngrg 181 iflvresett kgayslsird wdeirgdnvk hykirkldng gyyittraqf dtlqklvkhy 241 tehadglchk lttvcptvkp gtgglakdaw eipreslrle vklgqgcfge vwmgtwngtt 301 kvaiktlkpg tmmpeaflqe agimkklrhd klvplyavvs eepiyivtef mskgslldfl 361 kegdgkylkl pqlvdmaaqi adgmayierm nyihrdlraa nilvgenlvc kiadfglarl 421 iedneytarq gakfpikwta peaalygrft iksdvwsfgi lgtelvtkgr vpypgmvnre 481 vlegvergyr mpcpqgcpes lhelmnlcwk kdpderptfe yiqsfledyf tatepgygpg 541 enl
```

Coiled-coil domain containing 80, coiled-coil domain-containing 80 precursor, NP_955805.1, NP_955806.1
(SEQ ID NO: 164)
```
  1 mtwrmgprft mllamwlvcg sephphatir gshggrkvpl vspdssrpar flrhtgrsrg 61 ierstleepn lqplqrrrsv pvlrlarpte pparsdinga avrpeqrpaa rgspremird 121 egssarsrml rfpsgssspn ilasfagknr vwvisaphas egyyrlmmsl lkddvycela 181 erhiqqivlf hqageeggkv rritsegqil eqpldpslip klmsflklek gkfgmvllkk 241 tlqveerypy pvrleamyev idqgpirrie kirqkgfvqk ckasgvegqv vaegndgggg 301 agrpslgsek kkedprraqv pptresrvkv lrklaatapa lpqppstpra ttlppapatt 361 vtrstsravt vaarpmttta fpttqrpwtp spshrppttt evitarrpsv senlyppsrk 421 dqhrerpqtt rrpskatsle sftnappti sepstraagp grfrdnrmdr rehghrdpnv 481 vpgppkpake kppkkaqdk ilsneyeeky dlsrptasql edelqvgnvp lkkakeskkh 541 eklekpekek kkkmknenad kllksekqmk ksekkskqek ekskkkkggk teqdgyqkpt 601 nkhftqspkk svadllgsfe gkrrllita pkaennmyvq qrdeylesfc kmatrkisvi 661 tifgpvnnst mkidhfqldn ekpmrvvdde dlvdqrlise lrkeygmtyn dffmvltdvd 721 lrvkqyyevp itmksvfdli dtfqsrikdm ekqkkegivc kedkkgslen flsrfrwrrr 781 llvisapnde dwaysqqlsa lsgqacnfgl rhitilkllg vgeevggvle lfpingssvv 841 eredvpahlv kdirnyfqvs peyfsmllvg kdgnvkswyp spmwsmvivy dlidsmqlrr 901 qemaiqqslg mrcpedeyag ygyhsyhqgy qdgyqddyrh hesyhhgypy
```

Acrosin-binding protein precursor NP_115878.2
(SEQ ID NO: 165)
```
  1 mrkpaagflp sllkvlllpl apaaaqdstq astpgsplsp teyerffall tptwkaettc
```

-continued

```
  61 rlrathgcrn ptivqldqye nhglvpdgav csnlpyaswf esfcqfthyr csnhvyyakr 121 vlcsqpvsil spntlkeiea saevspttmt spisphftvt erqtfqpwpe rlsnnveell 181 qsslslggqe qapehkqeqg vehrgeptge hkqeegqkqe egeeeqeeeg kqeegqgtke 241 greaysqlqt dsepkfhses lssnpssfap rvrevestpm imeniqelir sageidemne 301 iydensywrn qnpgsllqlp hteallvlcy siventciit ptakawkyme eeilgfgksv 361 cdslgrrhms tcalcdfcsl kleqchseas lqrqqcdtsh ktpfvsplla sqslsignqv 421 gspesgrfyg ldlygglhmd fwcarlatkg cedvrvsgwl qteflsfqdg dfptkicdtd 481 yiqypnycsf ksqqclmrnr nrkvsrmrcl qnetysalsp gksedvvlrw sqefstltlg 541 qfg
```

Alpha-fetoprotein, isoform 1 NP_001125.1
(SEQ ID NO: 166)
```
   1 mkwvesifli fllnftesrt lhrneygias ildsyqctae isladlatif faqfvqeaty 61 kevskmvkda ltaiekptgd egssgclenq lpafleelch ekeilekygh sdccsqseeg 121 rhncflahkk ptpasiplfq vpepvtscea yeedretfmn kfiyeiarrh pflyaptill 181 waarydkiip scckaenave cfqtkaatvt kelresslln qhacavmknf gtrtfgaitv 241 tklsqkftkv nfteiqklvl dvahvhehcc rgdvldclqd gekimsyics qqdtlsnkit 301 eccklttler gqciihaend ekpeglspnl nrflgdrdfn qfssgeknif lasfvheysr 361 rhpqlaysvi lrvakgyqel lekcfqtenp lecqdkgeee lqkyiqesqa lakrscglfq 421 klgeyylqna flvaytkkap qltsselmai trkmaataat ccqlsedkll acgegaadii 481 ighlcirhem tpvnpgvgqc ctssyanrrp cfsslvvdet yvppafsddk fifhkdlcqa 541 qgvalqtmkq eflinlvkqk pqiteeqlea viadfsglle kccqgqeqev cfaeegqkli 601 sktraalgv
```

Alpha-fetoprotein, isoform 2 NP_001341646.1
(SEQ ID NO: 167)
```
   1 mnkfiyeiar rhpflyapti llwaarydki ipscckaena vecfqtkaat vtkelressl 61 lnqhacavmk nfgtrtfgai tvtklsqkft kvnfteigkl vldvahvheh ccrgdvldcl 121 qdgerimsyi csqqdtlsnk iteccklttl ergqciihae ndekpeglsp nlnrflgdrd 181 fnqfssgekn iflasfvhey srrhpqlays vilrvakgyq ellekcfqte nplecqdkge 241 eelqkyiqes qalakrscgl fqklgeyylq naflvaytkk apqltsselm aitrkmaata 301 atccqlsedk llacgegaad iiighlcirh emtpvnpgvg qcctssyanr rpcfsslvvd 361 etyvppafsd dkfifhkdlc gaggvalgtm kqeflinlvk qkpqiteeql eaviadfsgl 421 lekccqgqeq evcfaeegqk lisktraalg v
```

Absent in melanoma 1 protein NP_001615.2
(SEQ ID NO: 168)
```
   1 mplsppaqgd pgepsperpp kkhttfhlwr skkkqqpapp dcgvfvphpl papagearal 61 dvvdgkyvvr dsqefplhcg esqffhttse algslllesg ifkksraqpp ednrrkpvlg 121 klgtlftagr rrnsrngles ptrsnakpls pkdvvaspkl peresersrs qssqlkqtdt 181 seegsprenp reaegelpes ggpaappdae lsprwsssaa avavqqchen dspqleplea 241 egepfpdatt takqlhsspg nssrgenaet parspgedas pgagheqeaf lgvrgapgsp 301 tqerpagglg eapngapsvc aeegslgprn arsqppkgas dlpgeppaeg aahtassaqa 361 dctarpkgha hpakvltldi ylsktegaqv depvvitpra edcgdwddme krssgrrsgr 421 rrgsqkstds pgadaelpes aarddavfdd evapnaasdn asaekkvksp raaldggvas 481 aaspeskpsp gtkgqlrges drskqpppas sptkrkgrsr aleavpappa sgprapakes 541 ppkrvpdpsp vtkgtaaesg eeaaraipre lpvksssllp eikpehkrgp lpnhfngrae
```

-continued

```
 601 ggrsrelgra agapgasdad glkprnhfgv grstvttkvt lpakpkhvel nlktpknlds
 661 lgnehnpfsq pvhkgntatk islfenkrtn ssprhtdirg qrntpasskt fvgraklnla
 721 kkakemeqpe kkvmpnspqn gvlvketaie tkvtvseeei lpatrgmngd ssengalgpq
 781 pnqddkadvq tdagclsepv asalipvkdh kllekedsea adskslvlen vtdtagdipt
 841 tvdtkdlppt ampkpqhtfs dsgspaessp gpslslsapa pgdvpkdtcv qspissfpct
 901 dlkvsenhkg cvlpvsrqnn ekmpllelgg ettpplster speavgsecp srvlvqvrsf
 961 vlpvestqdv ssqvipesse vrevqlptch snepevvsva scappqeevl gnehshctae
1021 laaksgpqvi ppasektlpi qaqsqgsrtp lmaesssptns pssgnhlatp grpdgtvtng
1081 qdspasllni sagsddsvfd sssdmekfte iikqmdsavc mpmkrkkarm pnspaphfam
1141 ppihedhlek vfdpkvftfg lgkkkesqpe mspalhlmqn ldtksklrpk rasaeqsvlf
1201 kslhtntngn seplvmpein dkenrdvtng gikrsrleks alfssllssl pqdkifspsv
1261 tsvntmttaf stsqngslsq ssysqptteg appcglnkeq snllpdnslk vfnfnssssts
1321 hsslkspshm ekypqkektk edldsrsnlh lpetkfsels klknddmeka nhiesviksn
1381 lpncansdtd fmglfkssry dpsisfsgms lsdtmtlrgs vqnklnprpg kvviysepdv
1441 sekcievfsd iqdcsswsls pvilikvvrg cwilyeqpnf eghsipleeg elelsglwgi
1501 edilerheea esdkpvvigs irhvvqdyry shidlftepe glgilssyfd dteemqgfgv
1561 mqktcsmkvh wgtwliyeep gfqgvpfile pgeypdlsfw dteeayigsm rplkmggrkv
1621 efptdpkvvv yekpffegkc veletgmcsf vmeggeteea tgddhlpfts vgsmkvlrgi
1681 wvayekpgft ghqylleege yrdwkawggy ngelgslrpi lgdfsnahmi myseknfgsk
1741 gssidvlgiv anlketgygv ktqsinvlsg vwvayenpdf tgeqyildkg fytsfedwgg
1801 knckissvqp icldsftgpr rrnqihlfse pqfqghsgsf eettsqidds fstkscrvsg
1861 gswvvydgen ftgnqyvlee ghypclsamg cppgatfksl rfidvefsep tiilferedf
1921 kgkkielnae tvnlrslgfn tqirsvqvig giwvtyeygs yrgrqfllsp aevpnwyefs
1981 gcrqigslrp fvqkriyfrl rnkatglfms tngnledlkl lriqvmedvg addqiwiyqe
2041 gcikcriaed ccltivgslv tsgsklglal dqnadsqfws lksdgriysk lkpnlvldik
2101 ggtqydqnhi ilntvskekf tqvweamvly t
```

A-kinase anchoring protein 4, isoform 1 NP_003877.2
(SEQ ID NO: 169)

```
  1 mmaysdttmm sddidwlrsh rgvckvdlyn pegqqdqdrk vicfvdvstl nvedkdykda
 61 asssssegnln lgsleekeii vikdtekkdq sktegsvclf kqapsdpvsv lnwllsdlqk
121 yalgfqhals pststckhkv gdtegeyhra ssencysvya dqvnidylmn rpqnlrlemt
181 aakntnnnqs psappakpps tqravispdg ecsiddlsfy vnrlsslviq mahkeikekl
241 egkskclhhs icpspgnker isprtpaski asemayeave ltaaemrgtg eesreggqks
301 flyselsnks ksgdkqmsqr eskefadsis kglmvyanqv asdmmvslmk tlkvhssgkp
361 ipasvvlkrv llrhtkeivs dlidscmknl hnitgvlmtd sdfvsavkrn lfnqwkqnat
421 dimeamlkrl vsaligeeke tksgslsyas lkagshdpkc rnqslefstm kaemkerdkg
481 kmksdpcksl tsaekvgehi lkegltiwnq kqgnsckvat kacsnkdekg ekinastdsl
541 akdlivsalk liqyhltqqt kgkdtceedc pgstmgymaq stgyekcggg qsakalsvkq
601 leshrapgps tcqkenqhld sqkmdmsniv lmliqkllne npfkcedpce genkcsepra
661 skaasmsnrs dkaeeqcqeh qeldctsgmk ganggfidkl vesvmklcli makysndgaa
721 laeleeqaas ankpnfrgtr cihsgampqn yqdslghevi vnnqcstnsl qkqlqavlqw
```

-continued

```
781 iaasqfnvpm lyfmgdkdgq leklpqvsak aaekgysvgg llgevmkfak erqpdeavgk 841 varkqlldwl lanl
```

A-kinase anchoring protein 4, isoform 2 NP_647450.1

(SEQ ID NO: 170)

```
  1 msddidwlrs hrgvckvdly npegqqdqdr kvicfvdvst lnvedkdykd aasssegnl 61 nlgsleekei ivikdtekkd gskategsvcl fkqapsdpvs vinwllsdlq kyalgfqhal 121 spststckhk vgdtegeyhr assencysvy adqvnidylm nrpqnlrlem taakntnnnq 181 spsappakpp stqravispd gecsiddlsf yvnrlsslvi qmahkeikek legkskclhh 241 sicpspgnke risprtpask iasemayeav eltaaemrgt geesreggqk sflyselsnk 301 sksgdkqmsq reskefadsi skglmvyanq vasdmmvslm ktlkvhssgk pipasvvlkr 361 vllrhtkeiv sdlidscmkn lhnitgvlmt dsdfvsavkr nlfnqwkqna tdimeamlkr 421 lvsaligeek etksqslsya slkagshdpk crnqslefst mkaemkerdk gkmksdpcks 481 ltsaekvgeh ilkegltiwn qkqgnsckva tkacsnkdek gekinastds lakdlivsal 541 kliqyhltqg tkgkdtceed cpgstmgyma gstgyekcgg gqsakalsvk qleshrapgp 601 stcqkenqhl dsqkmdmsni vlmliqklln enpfkcedpc egenkcsepr askaasmsnr 661 sdkaeeqcqe hqeldctsgm kganggfidk lvesvmklcl imakysndga alaeleeqaa 721 sankpnfrgt rcihsgampq nygdslghev ivnnqcstns lqkqlqavlq wiaasqfnvp 781 mlyfmgdkdg qleklpqvsa kaaekgysvg gllqevmkfa kerqpdeavg kvarkqlldw 841 llanl
```

ALK tryrosine kinase receptor, isoform 1 NP_004295.2

(SEQ ID NO: 171)

```
   1 mgaigllwll plllstaavg sgmgtgqrag spaagpplqp replsysrlq rkslavdfvv 61 pslfrvyard lllppsssel kagrpeargs laldcapllr llgpapgvsw tagspapaea 121 rtlsrvlkgg svrklrrakq lvlelgeeai legcvgppge aavgllqfnl selfswwirq 181 gegrlrirlm pekkasevgr egrlsaaira sqprllfqif gtghsslesp tnmpspspdy 241 ftwnitwimk dsfpflshrs ryglecsfdf pceleysppl hdlrngswsw rripseeasq 301 mdlldgpgae rskemprgsf lllntsadsk htilspwmrs ssehctlays vhrhlqpsgr 361 yiaqllphne aareilllmpt pgkhgwtvlq grigrpdnpf rvaleyissg nrslsavdff 421 alkncsegts pgskmalqss ftcwngtvlq lgqacdfhqd caggedesqm crklpvgfyc 481 nfedgfcgwt qgtlsphtpq wqvrtlkdar fqdhqdhall lsttdvpase satvtsatfp 541 apiksspcel rmswlirgvl rgnvslvlve nktgkeqgrm vwhvaayegl slwqmwvlpl 601 ldvsdrfwlq mvawwgqgsr aivafdnisi sldcyltisg edkilqntap ksrnlfernp 661 nkelkpgens prqtpifdpt vhwlfttcga sgphgptqaq cnnayqnsnl svevgsegpl 721 kgiqiwkvpa tdtysisgyg aaggkggknt mmrshgvsvl gifnlekddm lyilvgqqge 781 dacpstnqli qkvcigennv ieeeirvnrs vhewaggggg gggatyvfkm kdgvpvplii 841 aaggggrayg aktdtfhper lennssvlgl ngnsgaaggg ggwndntsll wagkslqega 901 tgghscpqam kkwgwetrgg fgggggcss gggggyigg naasnndpem dgedgvsfis 961 plgilytpal kvmeghgevn ikhylncshc evdechmdpe shkvicfcdh gtvlaedgvs 1021 civspteph lplslilsvv tsalvaalvl afsgimivyr rkhgelqamq melqspeykl 1081 sklrtstimt dynpnycfag ktssisdlke vprknitlir glghgafgev yegqvsgmpn 1141 dpsplqvavk tlpevcseqd eldflmeali iskfnhqniv rcigvslqsl prfillelma 1201 ggdlksflre trprpsqpss lamldllhva rdiacgcqyl eenhfihrdi aarncllltcp 1261 gpgrvakigd fgmardiyra syyrkggcam lpvkwmppea fmegiftskt dtwsfgvllw
```

-continued

```
1321 eifslgympy psksnqevle fvtsggrmdp pkncpgpvyr imtqcwqhqp edrpnfaiil 1381 erieyctqdp dvintalpie ygplveeeek vpvrpkdpeg vppllvsqqa kreeerspaa 1441 ppplpttssg kaakkptaae isvrvprgpa vegghvnmaf sqsnppselh kvhgsrnkpt 1501 slwnptygsw ftekptkknn piakkephdr gnlglegsct vppnvatgrl pgaslllleps 1561 sltanmkevp lfrlrhfpcg nvnygyqqqg lpleaatapg aghyedtilk sknsmnqpgp
```

ALK tyrosin kinese receptor, isoform 2 NP_001340694.1
(SEQ ID NO: 172)

```
  1 mqmelqspey klsklrtsti mtdynpnycf agktssisdl kevprknitl irglghgafg 61 evyegqvsgm pndpsplqva vktlpevcse qdeldflmea liiskfnhqn ivrcigvslq 121 slprfillel maggdlksfl retrprpsqp sslamldllh vardiacgcq yleenhfihr 181 diaarncllt cpgpgrvaki gdfgmardiy rasyyrkggc amlpvkwmpp eafmegifts 241 ktdtwsfgvl lweifslgym pypsksnqev lefvtsggrm dppkncpgpv yrimtqcwqh 301 qpedrpnfai ilerieyctq dpdvintalp ieygplveee kvpvrpkdp egvppllvsq 361 qakreeersp aappplptts sgkaakkpta aeisvrvprg pavegghvnm afsqsnppse 421 lhkvhgsrnk ptslwnptyg swftekptkk nnpiakkeph drgnlglegs ctvppnvatg 481 rlpgasllle pssltanmke vplfrlrhfp cgnvnygyqq qglpleaata pgaghyedti 541 lksknsmnqp gp
```

Angiopoietin-2, isoform a NP_001138.1
(SEQ ID NO: 173)

```
  1 mwqivfftls cdlvlaaayn nfrksmdsig kkgyqvghgs csytfllpem dncrsssspy 61 vsnavqrdap leyddsvqrl qvlenimenn tqwlmkleny iqdnmkkemv eiggnavqnq 121 tavmieigtn llnqtaeqtr kltdveaqvl nqttrlelql lehslstnkl ekgildqtse 181 inklqdknsf lekkvlamed khiiqlqsik eekdqlqvlv skqnsiieel ekkivtatvn 241 nsvlqkqqhd lmetvnnllt mmstsnsakd ptvakeeqis frdcaevfks ghttngiytl 301 tfpnsteeik aycdmeaggg gwtiiqrred gsvdfqrtwk eykvgfgnps geywlgnefv 361 sqltnqqryv lkihlkdweg neayslyehf ylsseelnyr ihlkgltgta gkissisqpg 421 ndfstkdgdn dkcickcsqm ltggwwfdac gpsnlngmyy pqrqntnkfn gikwyywkgs 481 gyslkattmm irpadf
```

Angiopoietin-2, isoform b NP_001112359.1
(SEQ ID NO: 174)

```
  1 mwqivfftls cdlvlaaayn nfrksmdsig kkgyqvghgs csytfllpem dncrsssspy 61 vsnavqrdap leyddsvqrl qvlenimenn tqwlmkleny iqggnavqnq 121 tavmieigtn llnqtaeqtr kltdveaqvl nqttrlelql lehslstnkl ekqildqtse 181 inklqdknsf lekkvlamed khiiqlqsik eekdqlqvlv skqnsiieel ekkivtatvn 241 nsvlqkqqhd lmetvnnllt mmstsnskdp tvakeegisf rdcaevfksg httngiytlt 301 fpnsteeika ycdmeagggg wtiiqrredg svdfqrtwke ykvgfgnpsg eywlgnefvs 361 qltnqqryvl kihlkdwegn eayslyehfy lsseelnyri hlkgltgtag kissisqpgn 421 dfstkdgdnd kcickcsgml tggwwfdacg psnlngmyyp qrqntnkfng ikwyywkgsg 481 yslkattmmi rpadf
```

Angiopoietin-2, isoform c NP_001112360.1
(SEQ ID NO: 175)

```
  1 mwqivfftls cdlvlaaayn nfrksmdsig kkgyqvghgs csytfllpem dncrsssspy 61 vsnavqrdap leyddsvqrl qvlenimenn tqwlmkvinq ttrlelqlle hslstnklek 121 gildqtsein klqdknsfle kkvlamedkh iiqlqsikee kdqlqvlvsk qnsiieelek
```

-continued

```
181 kivtatvnns vlqkqqhdlm etvnnlltmm stsnsakdpt vakeegisfr dcaevfksgh 241 ttngiytltf pnsteeikay cdmeaggggw tiiqrredgs vdfqrtwkey kvgfgnpsge 301 ywlgnefvsq ltnqqryvlk ihlkdwegne ayslyehfyl sseelnyrih lkgltgtagk 361 issisqpgnd fstkdgdndk cickcsqmlt ggwwfdacgp snlngmyypq rqntnkfngi 421 kwyywkgsgy slkattmmir padf
```

Angiopoietin-1, isoform 1 precursor NP_001137.2

(SEQ ID NO: 176)

```
  1 mtvflsfafl aailthigcs nqrrspensg rrynriqhgq caytfilpeh dgncresttd 61 qyntnalqrd aphvepdfss qklqhlehvm enytqwlqkl enyivenmks emagiqgnav 121 qnhtatmlei gtsllsqtae qtrkltdvet qvinqtsrle iqllenslst yklekqllqg 181 tneilkihek nsllehkile megkhkeeld tlkeekenlq glvtrqtyii gelekqlnra 241 ttnnsvlqkq qlelmdtvhn lvnlctkegv llkggkreee kpfrdcadvy gagfnksgiy 301 tiyinnmpep kkvfcnmdvn gggwtviqhr edgsldfqrg wkeykmgfgn psgeywlgne 361 fifaitsqrq ymlrielmdw egnraysqyd rfhignekqn yrlylkghtg tagkqsslil 421 hgadfstkda dndncmckca lmltggwwfd acgpsnlngm fytagqnhgk lngikwhyfk 481 gpsyslrstt mmirpldf
```

Angiopoietin-1, isoform 2 precursor NP_001186788.1

(SEQ ID NO: 177)

```
  1 mtvflsfafl aailthigcs nqrrspensg rrynriqhgq caytfilpeh dgncresttd 61 qyntnalqrd aphvepdfss qklqhlehvm enytqwlqkl enyivenmks emagiqgnav 121 qnhtatmlei gtsllsqtae qtrkltdvet qvinqtsrle iqllenslst yklekqllqg 181 tneilkihek nsllehkile megkhkeeld tlkeekenlq glvtrqtyii qelekqlnra 241 ttnnsvlqkq qlelmdtvhn lvnlctkevl lkggkreeek pfrdcadvyq agfnksgiyt 301 iyinnmpepk kvfcnmdvng ggwtvighre dgsldfqrgw keykmgfgnp sgeywlgnef 361 ifaitsqrqy mlrielmdwe gnraysqydr fhignekqny rlylkghtgt agkqsslilh 421 gadfstkdad ndncmckcal mltggwwfda cgpsnlngmf ytagqnhgkl ngikwhyfkg 481 psyslrsttm mirpldf
```

Angiopoietin-1, isoform 3 precursor NP_001300980.1

(SEQ ID NO: 178)

```
  1 megkhkeeld tlkeekenlq glvtrqtyii gelekqlnra ttnnsvlqkq qlelmdtvhn 61 lvnlctkegv llkggkreee kpfrdcadvy gagfnksgiy tiyinnmpep kkvfcnmdvn 121 gggwtviqhr edgsldfqrg wkeykmgfgn psgeywlgne fifaitsgrq ymlrielmdw 181 egnraysqyd rfhignekqn yrlylkghtg tagkqsslil hgadfstkda dndncmckca 241 lmltggwwfd acgpsnlngm fytagqnhgk lngikwhyfk gpsyslrstt mmirpldf
```

Ankyrin repeat domain-containing protein 30A NP_443723.2

(SEQ ID NO: 179)

```
  1 mtkrkktinl niqdaqkrta lhwacvnghe evvtflvdrk cqldvldgeh rtplmkalqc 61 hqeacanili dsgadinlvd vygntalhya vyseilsvva kllshgavie vhnkasltpl 121 llsitkrseq ivefllikna nanavnkykc talmlavchg sseivgmllq qnvdvfaadi 181 cgvtaehyav tcgfhhiheq imeyirklsk nhqntnpegt sagtpdeaap laertpdtae 241 slvektpdea aplvertpdt aeslvektpd eaaslvegts dkiqclekat sgkfeqsaee 301 tpreitspak etsekftwpa kgrprkiawe kkedtpreim spaketsekf twaakgrprk 361 iawekketpv ktgcvarvts nktkvlekgr skmiacptke sstkasandq rfpseskqee 421 deeyscdsrs lfessakiqv cipesiyqkv meinreveep pkkpsafkpa iemqnsvpnk 481 afelkneqtl radpmfppes kqkdyeensw dseslcetvs qkdvclpkat hqkeidking
```

-continued

```
 541 kleespnkdg llkatcgmkv siptkalelk dmqtfkaepp gkpsafepat emqksvpnka
 601 lelkneqtlr adeilpsesk qkdyeenswd teslcetvsq kdvclpkaah qkeidkingk
 661 legspvkdgl lkancgmkvs iptkalelmd mqtfkaeppe kpsafepaie mqksvpnkal
 721 elknegtlra deilpseskq kdyeesswds eslcetvsqk dvclpkathq keidkingkl
 781 eespdndgfl kapermkvsi ptkalelmdm qtfkaeppek psafepaiem qksvpnkale
 841 lknegtlrad qmfpseskqk kveenswdse slretvsqkd vcvpkathqk emdkisgkle
 901 dstslskild tvhscerare lqkdhceqrt gkmeqmkkkf cvlkkklsea keiksqlenq
 961 kvkweqelcs vrltlnqeee krrnadilne kireelgrie eqhrkelevk qqlegalriq
1021 dielksvesn lnqvshthen enyllhencm lkkeiamlkl eiatlkhqyq ekenkyfedi
1081 kilkeknael qmtlklkees ltkrasqysg qlkvliaent mltsklkekq dkeileaeie
1141 shhprlasav qdhdqivtsr ksqepafhia gdaclqrkmn vdvsstiynn evlhqplsea
1201 qrkskslkin lnyagdalre ntivsehaqr dgretqcqmk eaehmygneg dnvnkhtegq
1261 esldqklfql qsknmwlqqq lvhahkkadn kskitidihf lerkmqhhll kekneeifny
1321 nnhlknriyq yekekaeten s
```

Androgen receptor, isoform 1 NP_000035.2

(SEQ ID NO: 180)

```
   1 mevqlglgry yprppsktyr gafqnlfqsv reviqnpgpr hpeaasaapp gaslllqqg
  61 qqqqqqqqq qqqqqqqqq etsprqqqqq qgedgspqah rrgptgylvl deeqqpsqpq
 121 salechperg cvpepgaava askglpqqlp appdeddsaa pstlsllgpt fpglsscsad
 181 lkdilseast mqllqqqqqe aysegssssgr areasgapts skdnylggts tisdnakelc
 241 kaysysmglg vealehlspg eqlrgdcmya pllgvppavr ptpcaplaec kgsllddsag
 301 kstedtaeys pfkggytkgl egeslgcsgs aaagssgtle lpstlslyks galdeaaayq
 361 srdyynfpla lagpppppp phpharikle npldygsawa aaaaqcrygd laslhgagaa
 421 gpgsgspsaa assswhtlft aeegqlygpc gggggggggg gggggggggg gggeagavap
 481 ygytrppqgl agqesdftap dvwypggmvs rvpypsptcv ksemgpwmds ysgpygdmrl
 541 etardhvlpi dyyfppqktc licgdeasgc hygaltcgsc kvffkraaeg kqkylcasrn
 601 dctidkfrrk ncpscrlrkc yeagmtlgar klkklgnlkl qeegeasstt spteettqkl
 661 tvshiegyec qpiflnvlea iepgvvcagh dnnqpdsfaa llsslnelge rqlvhvvkwa
 721 kalpgfrnlh vddqmaviqy swmglmvfam gwrsftnvns rmlyfapdlv fneyrmhksr
 781 mysqcvrmrh lsgefgwlqi tpqeflcmka lllfsiipvd glknqkffde lrmnyikeld
 841 riiackrknp tscsrrfyql tklldsvqpi arelhqftfd lliksyvsy dfpemmaeii
 901 svqvpkilsg kvkpiyfhtq
```

Androgen receptor, isoform 2 NP_001011645.1

(SEQ ID NO: 181)

```
   1 milwlhslet ardhvlpidy yfppqktcli cgdeasgchy galtcgsckv ffkraaegkq
  61 kylcasrndc tidkfrrknc pscrlrkcye agmtlgarkl kklgnlklqe egeassttsp
 121 teettqkltv shiegyecqp iflnvleaie pgvvcaghdn nqpdsfaall sslnelgerq
 181 lvhvvkwaka lpgfrnlhvd dqmavigysw mglmvfamgw rsftnvnsrm lyfapdlvfn
 241 eyrmhksrmy sqcvrmrhls gefgwlgitp geflcmkall lfsiipvdgl knqkffdelr
 301 mnyikeldri iackrknpts csrrfyqltk lldsvqpiar elhqftfdll ikshmvsvdf
 361 pemmaeiisv qvpkilsgkv kpiyfhtq
```

Androgen receptor, isoform 3 NP_001334990.1
(SEQ ID NO: 182)

```
  1 mevqlglgry yprppsktyr gafqnlfqsv reviqnpgpr hpeaasaapp gaslllqqg
 61 qqqqqqqqq qqqqqqqqq etsprqqqqq qgedgspqah rrgptgylvl deeqqpsqpq
121 salechperg cvpepgaava askglpqqlp appdeddsaa pstlsllgpt fpglsscsad
181 lkdilseast mqllqqqqqe avsegsssgr areasgapts skdnylggts tisdnakelc
241 kaysysmglg vealehlspg eqlrgdcmya pllgvppavr ptpcaplaec kgslddsag
301 kstedtaeys pfkggytkgl egeslgcsgs aaagssgtle lpstlslyks galdeaaayq
361 srdyynfpla lagpppppppp phpharikle npldygsawa aaaaqcrygd laslhgagaa
421 gpgsgspsaa assswhtlft aeegqlygpc gggggggggg gggggggggg gggeagavap
481 ygytrppqgl agqesdftap dvwypggmvs rvpypsptcv ksemgpwmds ysgpygdmrl
541 etardhvlpi dyyfppqktc licgdeasgc hygaltcgsc kvffkraaeg kqkylcasrn
601 dctidkfrrk ncpscrlrkc yeagmtlgek frvgnckhlk mtrp
```

Androgen receptor, isoform 4 NP_001334992.1
(SEQ ID NO: 183)

```
  1 mevqlglgry yprppsktyr gafqnlfqsv revignpgpr hpeaasaapp gaslllqqg
 61 qqqqqqqqq qqqqqqqqq etsprqqqqq ggedgspqah rrgptgylvl deeqqpsqpq
121 salechperg cvpepgaava askglpqqlp appdeddsaa pstlsllgpt fpglsscsad
181 lkdilseast mqllqqqqqe aysegsssgr areasgapts skdnylggts tisdnakelc
241 kaysysmglg vealehlspg eqlrgdcmya pllgvppavr ptpcaplaec kgslddsag
301 kstedtaeys pfkggytkgl egeslgcsgs aaagssgtle lpstlslyks galdeaaayq
361 srdyynfpla lagpppppppp phpharikle npldygsawa aaaaqcrygd laslhgagaa
421 gpgsgspsaa assswhtlft aeegqlygpc gggggggggg gggggggggg gggeagavap
481 ygytrppqgl agqesdftap dvwypggmvs rvpypsptcv ksemgpwmds ysgpygdmrl
541 etardhvlpi dyyfppqktc licgdeasgc hygaltcgsc kvffkraaeg kqkylcasrn
601 dctidkfrrk ncpscrlrkc yeagmtlgaa vvvserilry fgvsewlp
```

Androgen receptor, isoform 5 NP_001334993.1
(SEQ ID NO: 184)

```
  1 mevqlglgry yprppsktyr gafqnlfqsv revignpgpr hpeaasaapp gaslllqqg
 61 qqqqqqqqq qqqqqqqqq etsprqqqqq ggedgspqah rrgptgylvl deeqqpsqpq
121 salechperg cvpepgaava askglpqqlp appdeddsaa pstlsllgpt fpglsscsad
181 lkdilseast mqllqqqqqe aysegsssgr areasgapts skdnylggts tisdnakelc
241 kavsysmglg vealehlspg eqlrgdcmya pllgvppavr ptpcaplaec kgslddsag
301 kstedtaeys pfkggytkgl egeslgcsgs aaagssgtle lpstlslyks galdeaaayq
361 srdyynfpla lagpppppppp phpharikle npldygsawa aaaaqcrygd laslhgagaa
421 gpgsgspsaa assswhtlft aeegqlygpc gggggggggg gggggggggg gggeagavap
481 ygytrppqgl agqesdftap dvwypggmvs rvpypsptcv ksemgpwmds ysgpygdmrn
541 trrkrlwkli irsinscics pretevpvrq qk
```

ATPase H+ transporting accessory protein 1 NP_001174.2
(SEQ ID NO: 185)

```
  1 mmaamatarv rmgprcaqal wrmpwlpvfl slaaaaaaaa aeqqvplvlw ssdrdlwapa
 61 adtheghits dlqlstyldp alelgprnvl lflqdklsie dftayggvfg nkqdsafsnl
121 enaldlapss lvlpavdwya vstlttylqe klgasplhvd latlrelkln aslpalllir
181 lpytassglm aprevltgnd evigqvlstl ksedvpytaa ltavrpsrva rdvavvaggl
```

-continued

```
241 grqllqkqpv spvihppvsy ndtaprilfw aqnfsvaykd qwedltpltf gvqelnitgs 301 fwndsfarls ltyerlfgtt vtfkfilanr lypvsarhwf tmerlevhsn gsvayfnasq 361 vtgpsiysfh ceyvsslskk gsllvartqp spwqmmlqdf qiqafnvmge qfsyasdcas 421 ffspgiwmgl ltslfmlfif tyglhmilsl ktmdrfddhk gptisltqiv
```

B melanoma antigen 1 precursor NP_001178.1

(SEQ ID NO: 186)

```
  1 maaravflal saqllqarlm keespvvswr lepedgtalc fif
```

BCR/ABL fusion protein el4ab NG_050673.1

(SEQ ID NO: 187)

```
   1 gcacctgcag ggagggcagg cagctagcct gaaggctgat ccccccttcc tgttagcact 61 tttgatggga ctagtggact tggttcaga aggaagagct atgcttgtta gggcctcttg 121 tctcctccca ggagtggaca aggtgggtta ggagcagttt ctccctgagt ggctgctgct 181 gggtggttga ggagatgcac ggcttctgtt cctagtcaca aggctgcagc agacgctcct 241 cagatgctct gtgccttgga tctggcccca ctcccgtcct cccagccctc ctctcctcca 301 gctacctgcc agccggcact tttggtcaag ctgttttgca ttcactgttg cacatatgct 361 cagtcacaca cacagcatac gctatgcaca tgtgtccaca cacccccac ccacatccca 421 catcaccccg acccctctg ctgtccttgg aaccttatta cacttcgagt cactggtttg 481 cctgtattgt gaaaccagct ggatcctgag atccccaaga cagaaatcat gatgagtatg 541 tttttggccc atgacactgg cttaccttgt gccaggcaga tggcagccac acagtgtcca 601 ccggatggtt gattttgaag cagagttagc ttgtcacctg cctccctttc ccgggacaac 661 agaagctgac ctctttgatc tcttgcgcag atgatgagtc tccggggctc tatgggtttc 721 tgaatgtcat cgtccactca gccactggat ttaagcagag ttcaagtaag tactggtttg 781 gggaggaggg ttgcagcggc cgagccaggg tctccaccca ggaaggactc atcgggcagg 841 gtgtggggaa acagggaggt tgttcagatg accacgggac acctttgacc ctggccgctg 901 tggagtgttt gtgctggttg atgccttctg ggtgtggaat tgttttccc ggagtggcct 961 ctgccctctc ccctagcctg tctcagatcc tgggagctgg tgagctgccc cctgcaggtg 1021 gatcgagtaa ttgcagggt ttggcaagga ctttgacaga catccccagg ggtgcccggg 1081 agtgtgggggt ccaagccagg agggctgtca gcagtgcacc ttcaccccac agcagagcag 1141 atttggctgc tctgtcgagc tggatggata ctactttttt tttcctttcc ctctaagtgg 1201 gggtctcccc cagctactgg agctgtcaga acagtgaagg ctggtaacac atgagttgca 1261 ctgtgtaagt ttctcgaggc cgggcgcagt ggctcatgcc tgtaatccca gcactttggg 1321 aggctgaggc aggtggatcg cttgagctca ggagttggag accagcctga ccaacatggt 1381 gaaaccctgt gtctactaaa aatacaaaga ttagccgggc taggcagtgg gcacctgtaa 1441 tcacaactgc ttgggaggct gagggaagag aatcgcttga acccaggagg cggaggttgc 1501 agtgagccga gcttgtgcca ctgcattcca gcctgggcga cagagcaaga ctccgcctca 1561 aaaaaaaaaa aaaaagttc ctagaaacag caaaatgtgg agacagaaag cttaccaggg 1621 attgttgggg aatggggttg ggagagagga ctaactgcag atgaacccaa ggggactttt 1681 ttaggtgaga gcagtgtcgt gaaaagactg tggtgctgtt tgcgctcaca tttacatttc 1741 ctaaaattct ttaaacccta cacttggaat ggatgaatta catgacatgc agattgcacc 1801 ttcataacat aatctttctc ctgggcccct gtctctggct gcctcataaa cgctggtgtt 1861 tccctcgtgg gcctccctgc atccctgcat ctcctcccgg gtcctgtctg tgagcaatac 1921 agcgtgacac cctacgctgc cccgtggtcc cgggcttgtc tctccttgcc tcctgttac 1981 cttctttct atctcttcct tgccccgtgc actcaacctt gcatccccaa accaaaccta
```

-continued

```
2041 ttattcatgg accccaaact tgttcctctt atgtcctgtc cctttgaggg gcaccaccat
2101 ccacccgcat ggccaagcca gaaaccgtgg tctgctctcc ctccgttaaa tgccattctc
2161 catcagtgag gcttcttagt catctctggc tgcctggcca ggccctggct gtggcctcct
2221 ccctggtctt tgtagctctg gatatccctg cagaaagggt ccccactacc aggcctctcc
2281 atccccagtc tcaggtagtt tttctaaaat gcaaacccca ccctgcaact taccgcccac
2341 agccagccc actcttctcc aggcctcgcc tccctccctt cccctgcac ccacgactt
2401 ctccagcact gagctgcttc ctgtgcccca cagtggcctg gagtcccctt tgccttaact
2461 ctttgcccca tagtacagcg gggtctgctc tgattgtagg ggcttccac atcccccagg
2521 atggctgccc tctgctgtgg catcactgtg taacaatggc gtgtacacct ctctgtcccc
2581 accagtgcag ggcccttctc atcgtagggg ctttagctgg ggtttgtgga tcgactgagt
2641 gaacgaatgt tgtgggaagt cccgtttccc agccgcaccc agggaaattc cacagagcgg
2701 gcaggggcat cgcatgaggt gctggtgttc acgccagacc acaattaggt gtttaatttt
2761 taaaagaaa gttacaacct ttttttttta tttttatttt ttctgattct gcaaataaca
2821 cctgctctta cagaccatgt gggtgatgtg gaaaagacct gtgaccttct ccatgtccac
2881 ttctccccac agatctgtac tgcaccctgg aggtggattc ctttgggtat tttgtgaata
2941 aagcaaagac gcgcgtctac agggacacag ctgagcca
```

Serine/threonine-protein kinase B-raf, isoform 1 NP_004324.2
(SEQ ID NO: 188)

```
  1 maalsggggg gaepgqalfn gdmepeagag agaaassaad paipeevwni kqmikltgeh
 61 iealldkfgg ehnppsiyle ayeeytskld alggreqqll eslgngtdfs vsssasmdtv
121 tsssssslsv lpsslsvfqn ptdvarsnpk spqkpivrvf lpnkqrtvvp arcgvtvrds
181 lkkalmmrgl ipeccavyri qdgekkpigw dtdiswltge elhvevlenv pltthnfvrk
241 tfftlafcdf crkllfqgfr cqtcgykfhq rcstevplmc vnydqldllf vskffehhpi
301 pqeeaslaet altsgsspsa pasdsigpqi ltspspsksi pipqpfrpad edhrnqfgqr
361 drsssapnvh intiepvnid dlirdqgfrg dggsttglsa tppaslpgsl tnvkalqksp
421 gpqrerksss ssedrnrmkt lgrrdssddw eipdgqitvg qrigsgsfgt vykgkwhgdv
481 avkmlnvtap tpqqlqafkn evgvlrktrh vnillfmgys tkpglaivtq wcegsslyhh
541 lhiietkfem iklidiarqt aqgmdylhak siihrdlksn niflhedltv kigdfglatv
601 ksrwsgshqf eqlsgsilwm apevirmqdk npysfqsdvy afgivlyelm tgqlpysnin
661 nrdqiifmvg rgylspdlsk vrsncpkamk rlmaeclkkk rderplfpqi lasiellars
721 lpkihrsase pslnragfqt edfslyacas pktpigaggy gafpvh
```

Serine/threonine-protein kinase B-raf, isoform 2 NP_001341538.1
(SEQ ID NO: 189)

```
  1 maalsggggg gaepgqalfn gdmepeagag agaaassaad paipeevwni kqmikltgeh
 61 iealldkfgg ehnppsiyle ayeeytskld alggreqqll eslgngtdfs vsssasmdtv
121 tsssssslsv lpsslsvfqn ptdvarsnpk spqkpivrvf lpnkqrtvvp arcgvtvrds
181 lkkalmmrgl ipeccavyri qdgekkpigw dtdiswltge elhvevlenv pltthnfvrk
241 tfftlafcdf crkllfqgfr cqtcgykfhq rcstevplmc vnydqldllf vskffehhpi
301 pqeeaslaet altsgsspsa pasdsigpqi ltspspsksi pipqpfrpad edhrnqfgqr
361 drsssapnvh intiepvnid dlirdqgfrg dggsttglsa tppaslpgsl tnvkalqksp
421 gpqrerksss ssedrnrmkt lgrrdssddw eipdgqitvg qrigsgsfgt vykgkwhgdv
481 avkmlnvtap tpqqlqafkn evgvlrktrh vnillfmgys tkpglaivtq wcegsslyhh
```

```
541 lhiietkfem iklidiarqt aggmdylhak siihrdlksn niflhedltv kigdfglatv 601 ksrwsgshqf eqlsgsilwm apevirmqdk npysfqsdvy afgivlyelm tgqlpysnin 661 nrdqiifmvg rgylspdlsk vrsncpkamk rlmaeclkkk rderplfpqi lasiellars 721 lpkihrsase pslnragfqt edfslyacas pktpigaggy gefaafk
```

Carbonic anhydrase 9 precursor NP_001207.2

(SEQ ID NO: 190)

```
  1 maplcpspwl pllipapapg ltvqlllsll llvpvhpqrl prmqedsplg ggssgeddpl 61 geedlpseed spreedppge edlpgeedlp geedlpevkp kseeegslkl edlptveapg 121 dpqepqnnah rdkegddqsh wryggdppwp rvspacagrf qspvdirpql aafcpalrpl 181 ellgfqlppl pelrlrnngh svqltlppgl emalgpgrey ralqlhlhwg aagrpgseht 241 veghrfpaei hvvhlstafa rvdealgrpg glavlaafle egpeensaye qllsrleeia 301 eegsetqvpg ldisallpsd fsryfqyegs lttppcaqgv iwtvfnqtvm lsakqlhtls 361 dtlwgpgdsr lqlnfratqp lngrvieasf pagvdsspra aepvglnscl aagdilalvf 421 gllfavtsva flvqmrrqhr rgtkggvsyr paevaetga
```

G/mitotic-specific cyclin-B1, isoform 1 NP_114172.1

(SEQ ID NO: 191)

```
  1 malrvtrnsk inaenkakin magakrvpta paatskpglr prtalgdign kvseqlqakm 61 pmkkeakpsa tgkvidkklp kplekvpmlv pvpvsepvpe pepepepepv keeklspepi 121 lvdtaspspm etsgcapaee dlcqafsdvi lavndvdaed gadpnlcsey vkdiyaylrq 181 leeeqavrpk yllgrevtgn mrailidwlv qvqmkfrllq etmymtvsii drfmqnncvp 241 kkmlqlvgvt amfiaskyee myppeigdfa fvtdntytkh girqmemkil ralnfglgrp 301 lplhflrras kigevdveqh tlakylmelt mldydmvhfp psgiaagafc lalkildnge 361 wtptlqhyls yteesllpvm qhlaknvvmv ngqltkhmtv knkyatskha kistlpqlns 421 alvqdlakav akv
```

G/mitotic-specific cyclin-B1, isoform 2 NP_001341773.1

(SEQ ID NO: 192)

```
  1 malrvtrnsk inaenkakin magakrvpta paatskpglr prtalgdign kvseqlqakm 61 pmkkeakpsa tgkvidkklp kplekvpmlv pvpvsepvpe pepepepepv keeklspepi 121 lvdtaspspm etsgcapaee dlcqafsdvi lavndvdaed gadpnlcsey vkdiyaylrq 181 leeeqavrpk yllgrevtgn mrailidwlv qvqmkfrllq etmymtvsii drfmqnncvp 241 kkmlqlvgvt amfiaskyee myppeigdfa fvtdntytkh girqmemkil ralnfglgrp 301 lplhflrras kigevdveqh tlakylmelt mldydmvhfp psgiaagafc lalkildnge 361 wtvknkyats khakistlpq lnsalvqdla kavakv
```

G/mitotic-specific cyclin-B1, isoform 3 NP_001341774.1

(SEQ ID NO: 193)

```
  1 malrvtrnsk inaenkakin magakrvpta paatskpglr prtalgdign kvseqlqakm 61 pmkkeakpsa tgkvidkklp kplekvpmlv pvpvsepvpe pepepepepv keeklspepi 121 lvdtaspspm etsgcapaee dlcqafsdvi lavndvdaed gadpnlcsey vkdiyaylrq 181 lenncvpkkm lqlvgvtamf iaskyeemyp peigdfafvt dntytkhqir qmemkilral 241 nfglgrplpl hflrraskig evdveqhtla kylmeltmld ydmvhfppsq iaagafclal 301 kildngewtp tlqhylsyte esllpvmghl aknvvmvnqg ltkhmtvknk yatskhakis 361 tlpqlnsalv qdlakavakv
```

CD276, isoform a precursor NP_001019907.1

(SEQ ID NO: 194)

```
  1 mlrrgspgm gvhvgaalga lwfcltgale vqvpedpvva lvgtdaticc sfspepgfsl 61 aqlnliwqlt dtkqlvhsfa egqdqgsaya nrtalfpdll aqgnaslrlq rvrvadegsf
```

-continued

```
121 tcfvsirdfg saayslqvaa pyskpsmtle pnkdlrpgdt vtitcssyqg ypeaevfwqd 181 gqgvpltgnv ttsqmaneqg lfdvhsilry vlgangtysc lvrnpvlqqd ahssvtitpq 241 rsptgavevq vpedpvvalv gtdatlrcsf spepgfslaq lnliwqltdt kqlvhsfteg 301 rdqgsayanr talfpdllaq gnaslrlqry rvadegsftc fvsirdfgsa ayslqvaapy 361 skpsmtlepn kdlrpgdtvt itcssyrgyp eaevfwgdgq gvpltgnvtt sqmanegglf 421 dvhsvlrvvl gangtysclv rnpvlqqdah gsvtitgqpm tfppealwvt vglsvclial 481 lvalafvcwr kikqsceeen agaedqdgeg egsktalqpl khsdskeddg geia
```

CD276, isoform b precursor NP_001316557.1, NP_079516.1
(SEQ ID NO: 195)
```
  1 mlrrrgspgm gvhvgaalga lwfcltgale vqvpedpvva lvgtdaticc sfspepgfsl 61 aqlnliwqlt dtkqlvhsfa egqdqgsaya nrtalfpdll aqgnaslrlq rvrvadegsf 121 tcfvsirdfg saayslqvaa pyskpsmtle pnkdlrpgdt vtitcssyrg ypeaevfwqd 181 gqgvpltgnv ttsgmaneqg lfdvhsvlry vlgangtysc lvrnpvlqqd ahgsvtitgq 241 pmtfppealw vtvglsvcli allvalafvc wrkikqscee enagaedqdg egegsktalq 301 plkhsdsked dgqeia
```

CD276, isoform c NP_001316558.1
(SEQ ID NO: 196)
```
  1 mtlepnkdlr pgdtvtitcs syqgypeaev fwqdgqgvpl tgnvttsqma neqglfdvhs 61 ilrvvlgang tysclvrnpv lqqdahssvt itpqrsptga vevqvpedpv valvgtdatl 121 rcsfspepgf slaqlnliwq ltdtkqlvhs ftegrdqgsa yanrtalfpd llaqgnaslr 181 lqrvrvadeg sftcfvsird fgsaayslqv aapyskpsmt lepnkdlrpg dtvtitcssy 241 rgypeaevfw qdgqgvpltg nvttsgmane qglfdvhsvl rvvlgangty sclvrnpvlq 301 qdahgsvtit gqpmtfppea lwvtvglsvc liallvalaf vcwrkikqsc eeenagaedq 361 dgegegskta lqplkhsdsk eddgqeia
```

Carcinoembryonic antigen-related cell adhesion molecule 3, isoform 1 precursor NP_001806.2
(SEQ ID NO: 197)
```
  1 mgppsasphr ecipwqglll tasllnfwnp pttaklties mplsvaegke vlllvhnlpq 61 hlfgyswykg ervdgnsliv gyvigtqqat pgaaysgret iytnasliq nvtqndigfy 121 tlqviksdlv neeatgqfhv ygenapglpv gavagivtgv lvgvalvaal vcflllaktg 181 rtsiqrdlke qqpgalapgr gpshssafsm splstaqapl pnprtaasiy eellkhdtni 241 ycrmdhkaev as
```

Carcinoembryonic antigen-related cell adhesion molecule 3, isoform 2 precursor NP_001264092.1
(SEQ ID NO: 198)
```
  1 mgppsasphr ecipwqglll tasllnfwnp pttaklties mplsvaegke vlllvhnlpq 61 hlfgyswykg ervdgnsliv gyvigtqqat pgaaysgret iytnasliq nvtqndigfy 121 tlqviksdlv neeatgqfhv ygenapglpv gavagivtgv lvgvalvaal vcflllaktg 181 rpwslpqlcl ldvpslhcpg pptqpqdssf hl
```

Carcinoembryonic antigen-related cell adhesion molecule 5, isoform 1 preprotein NP_001278413.1, NP_004354.3
(SEQ ID NO: 199)
```
  1 mespsapphr wcipwqrlll tasllftwnp pttaklties tpfnvaegke vlllvhnlpq 61 hlfgyswykg ervdgnrqii gyvigtqqat pgpaysgrei iypnasliq niiqndtgfy 121 tlhviksdlv neeatgqfrv ypelpkpsis snnskpvedk davaftcepe tqdatylwwv 181 nnqslpvspr lqlsngnrtl tlfnvtrndt asykcetqnp vsarrsdsvi lnvlygpdap 241 tisplntsyr sgenlnlsch aasnppaqys wfvngtfqqs tqelfipnit vnnsgsytcq
```

-continued

```
301 ahnsdtglnr ttvttitvya eppkpfitsn nsnpvededa valtcepeiq nttylwwvnn 361 qslpvsprlq lsndnrtltl lsvtrndvgp yecgignels vdhsdpviln vlygpddpti 421 spsytyyrpg vnlslschaa snppagyswl idgniqghtq elfisnitek nsglytcgan 481 nsasghsrtt vktitvsael pkpsissnns kpvedkdava ftcepeaqnt tylwwvngqs 541 lpvsprlqls ngnrtltlfn vtrndarayv cgiqnsysan rsdpvtldvl ygpdtpiisp 601 pdssylsgan lnlschsasn pspqyswrin gipqqhtqvl fiakitpnnn gtyacfvsnl 661 atgrnnsivk sitvsasgts pglsagatvg imigvlvgva li
```

Carcinoembryonic antigen-related cell adhesion molecule 5,
isoform 2 preprotein NP_001295327.1
(SEQ ID NO: 200)

```
  1 mespsapphr wcipwqrlll taslltfwnp pttaklties tpfnvaegke vlllvhnlpq 61 hlfgyswykg ervdgnrqii gyvigtqqat pgpaysgrei iypnaslliq niigndtgfy 121 tlhviksdlv neeatgqfry ypelpkpsis snnskpvedk davaftcepe tqdatylwwv 181 nnqslpvspr lqlsngnrtl tlfnvtrndt asykcetqnp vsarrsdsvi lnvlygpdap 241 tispintsyr sgenlnlsch aasnppaqys wfvngtfqqs tqelfipnit vnnsgsytcq 301 ahnsdtglnr ttvttitvye ppkpfitsnn snpvededav altcepeiqn ttylwwvnnq 361 slpvsprlql sndnrtltll svtrndvgpy ecgignelsv dhsdpvilnv lygpddptis 421 psytyyrpgv nlslschaas nppagyswli dgnigghtge lfisnitekn sglytcgann 481 sasghsrttv ktitvsaelp kpsissnnsk pvedkdavaf tcepeaqntt ylwwvngqsl 541 pvsprlqlsn gnrtltlfnv trndarayvc giqnsysanr sdpvtldvly gpdtpiispp 601 dssylsqanl nlschsasnp spqyswring ipqqhtqvlf iakitpnnng tyacfvsnla 661 tgrnnsivks itvsasgtsp glsagatvgi migvlvgval i
```

Baculoviral IAP repeat containing 2, isoform 1 NP_001157.1,
NP_001243092.1
(SEQ ID NO: 201)

```
  1 mhktasqrlf pgpsyqniks imedstilsd wtnsnkqkmk ydfscelyrm stystfpagv 61 pvserslara gfyytgvndk vkcfccglml dnwklgdspi qkhkqlypsc sfiqnlvsas 121 lgstskntsp mrnsfahsls ptlehsslfs gsysslspnp lnsravedis ssrtnpysya 181 msteearflt yhmwpltfls pselaragfy yigpgdrvac facggklsnw epkddamseh 241 rrhfpncpfl ensletlrfs isnlsmqtha armrtfmywp ssvpvqpeql asagfyyvgr 301 nddvkcfccd gglrcwesgd dpwvehakwf prceflirmk ggefvdeigg ryphllegll 361 stsdtteen adppiihfgp gesssedavm mntpvvksal emgfnrdlvk qtvqskiltt 421 genyktvndi vsallnaede kreeekekqa eemasddlsl irknrmalfq qltcvlpild 481 nllkanvink qehdiikqkt qiplgareli dtilvkgnaa anifknclke idstlyknlf 541 vdknmkyipt edvsglslee qlrrlgeert ckvcmdkevs vvfipcghlv vcqecapslr 601 kcpicrgiik gtvrtfls
```

Baculoviral IAP repeat containing 2, isoform 2 NP_001243095.1
(SEQ ID NO: 202)

```
  1 mstystfpag vpvserslar agfyytgvnd kvkcfccglm ldnwklgdsp igkhkglyps 61 csfiqnlvsa slgstsknts pmrnsfahsl sptlehsslf sgsysslspn pinsravedi 121 sssrtnpysy amsteearfl tyhmwpltfl spselaragf yyigpgdrva cfacggklsn 181 wepkddamse hrrhfpncpf lensletlrf sisnlsmqth aarmrtfmyw pssvpvqpeq 241 lasagfyyvg rnddvkcfcc dgglrcwesg ddpwvehakw fprceflirm kggefvdeig 301 gryphlleql lstsdtteege nadppiihfg pgesssedav mmntpvvksa lemgfnrdlv
```

```
361 kqtvqskilt tgenyktvnd ivsallnaed ekreeekekq aeemasddls lirknrmalf 421 qqltcvlpil dnllkanvin kqehdiikqk tqiplgarel idtilvkgna aanifknclk 481 eidstlyknl fvdknmkyip tedvsglsle eqlrrlgeer tckvcmdkev svvfipcghl 541 vvcqecapsl rkcpicrgii kgtvrtfls
```

Chondrosarcoma-associated gene 2/3 protein, isoform X1
XP_006724920.1
(SEQ ID NO: 203)

```
  1 mwmgliqlve gvkrkdqgfl ekefyhktni kmrceflacw paftvlgeaw rdqvdwsrll 61 rdtglvkmsr kprassplsn nhpptpkrrg sgrhpinpgp ealskfprqp grekgpikev 121 pgtkgsp
```

Chondrosarcoma-associated gene 2/3 protein, isoform X2
XP_016885512.1
(SEQ ID NO: 204)

```
  1 mwmgliqlve gvkrkdqgfl ekefyhktni kmrceflacw paftvlgeaw rdqvdwsrll 61 rdtglvkmsr kprassplsn nhpptpkrfp rqpgrekgpi kevpgtkgsp
```

Chondroitin sulfate proteoglycan 4 precursor NP_001888.2
(SEQ ID NO: 205)

```
   1 mqsgprpplp apglalaltl tmlarlasaa sffgenhlev pvataltdid lqlqfstsqp 61 eallllaagp adhlllqlys grlqvrlvlg geelrlqtpa etllsdsiph tvvltvvegw 121 atlsvdgfln assavpgapl evpyglfvgg tgtlglpylr gtsrplrgcl haatlngrsl 181 lrpltpdvhe gcaeefsasd dvalgfsgph slaafpawgt gdegtleftl ttqsrqapla 241 fqaggrrgdf iyvdifeghl ravvekgqgt vllhnsvpva dgqphevsvh inahrleisv 301 dqypthtsnr gvlsyleprg slllggldae asrhlgehrl gltpeatnas llgcmedlsv 361 ngqrrglrea lltrnmaagc rleeeeyedd ayghyeafst lapeawpame lpepcvpepg 421 lppvfanftq lltisplvva eggtawlewr hvqptldlme aelrksqvlf svtrgarhge 481 leldipgaqa rkmftlldvv nrkarfihdg sedtsdqlvl evsvtarvpm psclrrgqty 541 llpiqvnpvn dpphiifphg slmvilehtq kplgpevfqa ydpdsacegl tfqvlgtssg 601 lpverrdqpg epatefscre leagslvyvh rggpaqdltf rvsdglgasp patlkvvair 661 paiqihrstg lrlaqgsamp ilpanlsvet navgqdvsvl frvtgalqfg elqkqgaggv 721 egaewwatqa fhqrdveggr vrylstdpqh haydtvenla levqvgqeil snlsfpvtiq 781 ratvwmlrle plhtqntqqe tlttahleat leeagpsppt fhyevvqapr kgnlqlqgtr 841 lsdgqgftqd diqagrvtyg ataraseave dtfrfrvtap pyfsplytfp ihiggdpdap 901 vltnvllvvp eggegvlsad hlfvkslnsa sylyevmerp rhgrlawrgt qdkttmvtsf 961 tnedllrgrl vyqhddsett eddipfvatr ggessgdmaw eevrgvfrva iqpvndhapv 1021 qtisrifhva rggrrllttd dvafsdadsg fadaqlvltr kdllfgsiva vdeptrpiyr 1081 ftqedlrkrr vlfvhsgadr gwiqlqvsdg qhqatallev qasepylrva ngsslvvpqg 1141 gqgtidtavl hldtnldirs gdevhyhvta gprwgqlvra gqpatafsqg dlldgavlys 1201 hngslsprdt mafsveagpv htdatlqvti alegplaplk lvrhkkiyvf ggeaaeirrd 1261 qleaaqeavp padivfsvks ppsagylvmv srgaladepp sldpvqsfsq eavdtgrvly 1321 lhsrpeawsd afsldvasgl gaplegvlve levlpaaipl eaqnfsvpeg gsltlappll 1381 rvsgpyfptl lglslqvlep pqhgalgked gpqartlsaf swrmveeqli ryvhdgsetl 1441 tdsfvlmana semdrqshpv aftvtvlpvn dqppilttnt glqmwegata pipaealrst 1501 dgdsgsedlv ytieqpsngr vvlrgapgte vrsftqaqld gglvlfshrg tldggfrfrl 1561 sdgehtspgh ffrvtaqkqv llslkgsgtl tvcpgsvqpl ssqtlrasss agtdpqllly 1621 rvvrgpqlgr lfhaqqdstg ealvnftqae vyagnilyeh emppepfwea hdtlelqlss
```

-continued

```
1681 ppardvaatl avaysfeaac pqrpshlwkn kglwvpeggr aritvaalda snllasvpsp 1741 qrsehdvlfq vtqfpsrgql lvseeplhag qphflqsqla agqlvyahgg ggtqqdgfhf 1801 rahlqgpaga svagpqtsea faitvrdvne rppqpqasvp lrltrgsrap israqlsvvd 1861 pdsapgeiey evqraphngf lslvggglgp vtrftqadvd sgrlafvang ssvagifqls 1921 msdgaspplp mslavdilps aievqlrapl evpgalgrss lsqqqlrvvs dreepeaayr 1981 liqgpqyghl lvggrptsaf sqfqiqggev vfaftnfsss hdhfrvlala rgvnasavvn 2041 vtvrallhvw aggpwpqgat lrldptvlda gelanrtgsv prfrllegpr hgrvvrvpra 2101 rtepggsqlv eqftqqdled grlglevgrp egrapgpagd sltlelwaqg vppavasldf 2161 atepynaarp ysvallsvpe aarteagkpe sstptgepgp masspepava kggflsflea 2221 nmfsviipmc lvllllalil pllfylrkrn ktgkhdvqvl takprnglag dtetfrkvep 2281 gqaipltavp gqgpppggqp dpellqfcrt pnpalkngqy wv
```

Cancer/testis antigen 2 isoform LAGE-1a NP_758965.2
(SEQ ID NO: 206)
```
  1 mqaegrgtgg stgdadgpgg pgipdgpggn aggpgeagat ggrgprgaga arasgprgga 61 prgphggaas aqdgrcpcga rrpdsrllel hitmpfsspm eaelvrrils rdaaplprpg 121 avlkdftvsg nllfirltaa dhrqlqlsis sclqqlsllm witqcflpvf laqapsgqrr
```

Cancer/testis antigen 2 isoform LAGE-1b NP_066274.2
(SEQ ID NO: 207)
```
  1 mqaegrgtgg stgdadgpgg pgipdgpggn aggpgeagat ggrgprgaga arasgprgga 61 prgphggaas aqdgrcpcga rrpdsrllel hitmpfsspm eaelvrrils rdaaplprpg 121 avlkdftvsg nllfmsvrdq dregagrmry vgwglgsasp eggkardlrt pkhkvseqrp 181 gtpgppppeg aqgdgcrgva fnvmfsaphi
```

Transcriptional repressor CTCFL, isoform 1 NP_001255969.1, NP_001255970.1, NP_542185.2
(SEQ ID NO: 208)
```
  1 maateisvls eqftkikele lmpekglkee ekdgvcrekd hrspseleae rtsgafqdsv 61 leeevelvla pseesekyil tlqtvhftse avelqdmsll siqqqegvqv vvqqpgpgll 121 wleegprqsl qqcvaisigq elyspqemev lqfhaleenv mvasedskla vslaettgli 181 kleeeqeknq llaertkeql ffvetmsgde rsdeivltvs nsnveeqedq ptagqadaek 241 akstknqrkt kgakgtfhcd vcmftssrms sfnrhmktht sekphlchlc lktfrtvtll 301 rnhvnthtgt rpykcndcnm afvtsgelvr hrrykhthek pfkcsmckya sveasklkrh 361 vrshtgerpf qccqcsyasr dtyklkrhmr thsgekpyec hichtrftqs gtmkihilqk 421 hgenvpkyqc phcatiiark sdlrvhmrnl haysaaelkc rycsavfher yaliqhqkth 481 knekrfkckh csyackqerh mtahirthtg ekpftclscn kcfrqkqlln ahfrkyhdan 541 fiptvykcsk cgkgfsrwin lhrhsekcgs geaksaasgk grrtrkrkqt ilkeatkgqk 601 eaakgwkeaa ngdeaaaeea sttkgeqfpg emfpvacret tarvkeevde gvtcemllnt 661 mdk
```

Transcriptional repressor CTCFL, isoform 2 NP_001255971.1
(SEQ ID NO: 209)
```
  1 maateisvls eqftkikele lmpekglkee ekdgvcrekd hrspseleae rtsgafqdsv 61 leeevelvla pseesekyil tlqtvhftse avelqdmsll siqqqegvqv vvqqpgpgll 121 wleegprqsl qqcvaisiqq elyspqemev lqfhaleenv mvasedskla vslaettgli 181 kleeeqeknq llaertkeql ffvetmsgde rsdeivltvs nsnveeqedq ptagqadaek 241 akstknqrkt kgakgtfhcd vcmftssrms sfnrhmktht sekphlchlc lktfrtvtll 301 rnhvnthtgt rpykcndcnm afvtsgelvr hrrykhthek pfkcsmckya sveasklkrh
```

```
361 vrshtgerpf qccqcsyasr dtyklkrhmr thsgekpyec hichtrftqs gtmkihilqk 421 hgenvpkyqc phcatiiark sdlrvhmrnl haysaaelkc rycsavfher yaliqhqkth 481 knekrfkckh csyackqerh mtahirthtg ekpftclscn kcfrqkqlln ahfrkyhdan 541 fiptvykcsk cgkgfsrwin lhrhsekcgs geaksaasgk grrtrkrkqt ilkeatkgqk 601 eaakgwkeaa ngdaaaeeas ttkgeqfpge mfpvacrett arvkeevdeg vtcemllntm 661 dk
```

Transcriptional repressor CTCFL, isoform 3 NP_001255972.1
(SEQ ID NO: 210)

```
  1 maateisvls eqftkikele lmpekglkee ekdgvcrekd hrspseleae rtsgafqdsv 61 leeevelvla pseesekyil tlqtvhftse avelqdmsll siqqqegvqv vvqqpgpgll 121 wleegprqsl qqcvaisigq elyspqemev lqfhaleenv mvasedskla vslaettgli 181 kleeeqeknq llaertkeql ffvetmsgde rsdeivltvs nsnveeqedq ptagqadaek 241 akstknqrkt kgakgtfhcd vcmftssrms sfnrhmktht sekphlchlc lktfrtvtll 301 rnhvnthtgt rpykcndcnm afvtsgelvr hrrykhthek pfkcsmckya sveasklkrh 361 vrshtgerpf qccqcsyasr dtyklkrhmr thsgekpyec hichtrftqs gtmkihilqk 421 hgenvpkyqc phcatiiark sdlrvhmrnl haysaaelkc rycsavfher yaliqhqkth 481 knekrfkckh csyackqerh mtahirthtg ekpftclscn kcfrqkqlln ahfrkyhdan 541 fiptvykcsk cgkgfsrwin lhrhsekcgs geaksaasgk grrtrkrkqt ilkeatkgqk 601 eaakgwkeaa ngdeaaaeea sttkgeqfpg emfpvacret tarvkeevde gvtcemllnt 661 mdnsagctgr mmlvsawllg rpgetynggr rrgsrrvtw
```

Transcriptional repressor CTCFL, isoform 4 NP_001255973.1
(SEQ ID NO: 211)

```
  1 maateisvls eqftkikele lmpekglkee ekdgvcrekd hrspseleae rtsgafqdsv 61 leeevelvla pseesekyil tlqtvhftse avelqdmsll siqqqegvqv vvqqpgpgll 121 wleegprqsl qqcvaisigq elyspqemev lqfhaleenv mvasedskla vslaettgli 181 kleeeqeknq llaertkeql ffvetmsgde rsdeivltvs nsnveeqedq ptagqadaek 241 akstknqrkt kgakgtfhcd vcmftssrms sfnrhmktht sekphlchlc lktfrtvtll 301 rnhvnthtgt rpykcndcnm afvtsgelvr hrrykhthek pfkcsmckya sveasklkrh 361 vrshtgerpf qccqcsyasr dtyklkrhmr thsgekpyec hichtrftqs gtmkihilqk 421 hgenvpkyqc phcatiiark sdlrvhmrnl haysaaelkc rycsavfher yaliqhqkth 481 knekrfkckh csyackqerh mtahirthtg ekpftclscn kcfrqkqlln ahfrkyhdan 541 fiptvykcsk cgkgfsrwin lhrhsekcgs geaksaasgk grrtrkrkqt ilkeatkgqk 601 eaakgwkeaa ngdgvisahr nlcllgssds hasysgagit darhhawliv llflvemgfy 661 hvshs
```

Transcriptional repressor CTCFL, isoform 5 NP_001255974.1
(SEQ ID NO: 212)

```
  1 maateisvls eqftkikele lmpekglkee ekdgvcrekd hrspseleae rtsgafqdsv 61 leeevelvla pseesekyil tlqtvhftse avelqdmsll siqqqegvqv vvqqpgpgll 121 wleegprqsl qqcvaisiqq elyspqemev lqfhaleenv mvasedskla vslaettgli 181 kleeeqeknq llaertkeql ffvetmsgde rsdeivltvs nsnveeqedq ptagqadaek 241 akstknqrkt kgakgtfhcd vcmftssrms sfnrhmktht sekphlchlc lktfrtvtll 301 rnhvnthtgt rpykcndcnm afvtsgelvr hrrykhthek pfkcsmckya sveasklkrh 361 vrshtgerpf qccqcsyasr dtyklkrhmr thsgekpyec hichtrftqs gtmkihilqk
```

```
421 hgenvpkyqc phcatiiark sdlrvhmrnl haysaaelkc rycsavfher yaliqhqkth 481 knekrfkckh csyackqerh mtahirthtg ekpftclscn kcfrqkqlln ahfrkyhdan 541 fiptvykcsk cgkgfsrwil wvgnsevael ggpgsgpllr lgsgcppglh hpkaglgped 601 plpgqlrhtt agtglssllq gplcraa
```

Transcriptional repressor CTCFL, isoform 6 NP_001255975.1
(SEQ ID NO: 213)
```
  1 maateisvls eqftkikele lmpekglkee ekdgvcrekd hrspseleae rtsgafqdsv 61 leeevelvla pseesekyil tlqtvhftse avelqdmsll siqqqegvqv vvqqpgpgll 121 wleegprqsl qqcvaisiqq elyspqemev lqfhaleenv mvasedskla vslaettgli 181 kleeeqeknq llaertkeql ffvetmsgde rsdeivltvs nsnveeqedq ptagqadaek 241 akstknqrkt kgakgtfhcd vcmftssrms sfnrhmktht sekphlchlc lktfrtvtll 301 rnhvnthtgt rpykcndcnm afvtsgelvr hrrykhthek pfkcsmckya sveasklkrh 361 vrshtgerpf qccqcsyasr dtyklkrhmr thsgvhmrnl haysaaelkc rycsavfher 421 yaliqhqkth knekrfkckh csyackqerh mtahirthtg ekpftclscn kcfrqkqlln 481 ahfrkyhdan fiptvykcsk cgkgfsrwin lhrhsekcgs geaksaasgk grrtrkrkqt 541 ilkeatkgqk eaakgwkeaa ngdeaaaeea sttkgeqfpg emfpvacret tarvkeevde 601 gvtcemllnt mdk
```

Transcriptional repressor CTCFL, isoform 7 NP_001255976.1
(SEQ ID NO: 214)
```
  1 maateisvls eqftkikele lmpekglkee ekdgvcrekd hrspseleae rtsgafqdsv 61 leeevelvla pseesekyil tlqtvhftse avelqdmsll siqqqegvqv vvqqpgpgll 121 wleegprqsl qqcvaisiqq elyspqemev lqfhaleenv mvasedskla vslaettgli 181 kleeeqeknq llaertkeql ffvetmsgde rsdeivltvs nsnveeqedq ptagqadaek 241 akstknqrkt kgakgtfhcd vcmftssrms sfnrhmktht sekphlchlc lktfrtvtll 301 rnhvnthtgt rpykcndcnm afvtsgelvr hrrykhthek pfkcsmckya sveasklkrh 361 vrshtgerpf qccqcsyasr dtyklkrhmr thsgekpyec hichtrftqs gtmkihilqk 421 hgenvpkyqc phcatiiark sdlrvhmrnl haysaaelkc rycsavfher yaliqhqkth 481 knekrfkckh csyackqerh mtahirthtg ekpftclscn kcfrqkqlln ahfrkyhdan 541 fiptvykcsk cgkgfsrwit skwsglkpqt fit
```

Transcriptional repressor CTCFL, isoform 8 NP_001255977.1
(SEQ ID NO: 215)
```
  1 maateisvls eqftkikele lmpekglkee ekdgvcrekd hrspseleae rtsgafqdsv 61 leeevelvla pseesekyil tlqtvhftse avelqdmsll siqqqegvqv vvqqpgpgll 121 wleegprqsl qqcvaisiqq elyspqemev lqfhaleenv mvasedskla vslaettgli 181 kleeeqeknq llaertkeql ffvetmsgde rsdeivltvs nsnveeqedq ptagqadaek 241 akstknqrkt kgakgtfhcd vcmftssrms sfnrhmktht sekphlchlc lktfrtvtll 301 rnhvnthtgt rpykcndcnm afvtsgelvr hrrykhthek pfkcsmckya sveerhmtah 361 irthtgekpf tclscnkcfr qkqllnahfr kyhdanfipt vykcskcgkg fsrwilwvgn 421 sevaelggpg sgpllrlqsg cppglhhpka glgpedplpg qlrhttagtg lssllqgplc 481 raa
```

Transcriptional repressor CTCFL, isoform 9 NP_001255978.1
(SEQ ID NO: 216)
```
  1 msgdersdei vltvsnsnve eqedqptagq adaekakstk nqrktkgakg tfhcdvcmft 61 ssrmssfnrh mkthtsekph lchlclktfr tvtllrnhvn thtgtrpykc ndcnmafvts 121 gelvrhrryk hthekpfkcs mckyasveas klkrhvrsht gerpfqccqc syasrdtykl
```

-continued

```
181 krhmrthsge kpyechicht rftqsgtmki hilqkhgenv pkyqcphcat iiarksdlry 241 hmrnlhaysa aelkcrycsa vfheryaliq hqkthknekr fkckhcsyac kqerhmtahi 301 rthtgekpft clscnkcfrq kqllnahfrk yhdanfiptv ykcskcgkgf srwinlhrhs 361 ekcgsgeaks aasgkgrrtr krkqtilkea tkgqkeaakg wkeaangdgv isahrnlcll 421 gssdshasys gagitdarhh awlivllflv emgfyhvshs
```

Transcriptional repressor CTCFL, isoform 10 NP_001255979.1
(SEQ ID NO: 217)

```
  1 msgdersdei vltvsnsnve eqedqptagq adaekakstk nqrktkgakg tfhcdvcmft 61 ssrmssfnrh mkthtsekph lchlclktfr tvtllrnhvn thtgtrpykc ndcnmafvts 121 gelvrhrryk hthekpfkcs mckyasveas klkrhvrsht gerpfqccqc syasrdtykl 181 krhmrthsge kpyechicht rftqsgtmki hilqkhgenv pkyqcphcat iiarksdlry 241 hmrnlhaysa aelkcrycsa vfheryaliq hqkthknekr fkckhcsyac kqerhmtahi 301 rthtgekpft clscnkcfrq kqllnahfrk yhdanfiptv ykcskcgkgf srwilwvgns 361 evaelggpgs gpllrlqsgc ppglhhpkag lgpedplpgq lrhttagtgl ssllqgplcr 421 aa
```

Transcriptional repressor CTCFL, isoform 11 NP_001255980.1,
NP_001255981.1
(SEQ ID NO: 218)

```
  1 maateisvls eqftkikele lmpekglkee ekdgvcrekd hrspseleae rtsgafqdsv 61 leeevelvla pseesekyil tlqtvhftse avelqdmsll siqqqegvqv vvqqpgpgll 121 wleegprqsl qqcvaisiqq elyspqemev lqfhaleenv mvasedskla vslaettgli 181 kleeeqeknq llaertkeql ffvetmsgde rsdeivltvs nsnveeqedq ptagqadaek 241 akstknqrkt kgakgtfhcd vcmftssrms sfnrhmktht sekphlchlc lktfrtvtll 301 rnhvnthtgt rpykcndcnm afvtsgelvr hrrykhthek pfkcsmckya svevkpfldl 361 klhgilveaa vqvtpsvtns ricykqafyy sykiyagnnm hsll
```

Transcriptional repressor CTCFL, isoform 12 NP_001255983.1
(SEQ ID NO: 219)

```
  1 mftssrmssf nrhmkthtse kphlchlclk tfrtvtllrn hvnthtgtrp ykcndcnmaf 61 vtsgelvrhr rykhthekpf kcsmckyasv easklkrhvr shtgerpfqc cqcsyasrdt 121 yklkrhmrth sgekpyechi chtrftqsgt mkihilqkhg envpkyqcph catiiarksd 181 lrvhmrnlha ysaaelkcry csavfherya liqhqkthkn ekrfckhcs yackqerhmt 241 ahirthtgek pftclscnkc frqkqllnah frkyhdanfi ptvykcskcg kgfsrwinlh 301 rhsekcgsge aksaasgkgr rtrkrkqtil keatkgqkea akgwkeaang dgvisahrnl 361 cllgssdsha sysgagitda rhhawlivll flvemgfyhv shs
```

Transcriptional repressor CTCFL, isoform 13 NP_001255984.1
(SEQ ID NO: 220)

```
  1 mftssrmssf nrhmkthtse kphlchlclk tfrtvtllrn hvnthtgtrp ykcndcnmaf 61 vtsgelvrhr rykhthekpf kcsmckyasv easklkrhvr shtgerpfqc cqcsyasrdt 121 yklkrhmrth sgekpyechi chtrftqsgt mkihilqkhg envpkyqcph catiiarksd 181 lrvhmrnlha ysaaelkcry csavfherya liqhqkthkn ekrfckhcs yackqerhmt 241 ahirthtgek pftclscnkc frqkqllnah frkyhdanfi ptvykcskcg kgfsrwvly
```

Cytochrome P450 1B1 NP_000095.2
(SEQ ID NO: 221)

```
  1 mgtslspndp wpinplsiqq ttllllsvl atvhvgqrll rqrrqlrsa ppgpfawpli 61 gnaaavgqaa hlsfarlarr ygdvfqirlg scpivvinge raihgalvqg gsafadrpaf 121 asfrvvsggr smafghyseh wkvqrraahs mmrnfftrqp rsrqvleghv lsearelval
```

-continued

```
181 lvrgsadgaf ldprpltvva vanvmsavcf gcryshddpe frellshnee fgrtvgagsl 241 vdvmpwlqyf pnpvrtvfre feqlnrnfsn fildkflrhc eslrpgaapr dmmdafilsa 301 ekkaagdshg ggarldlenv patitdifga sqdtlstalq wllllftryp dvqtrvqael 361 dqvvgrdrlp cmgdqpnlpy vlaflyeamr fssfvpvtip hattantsvl gyhipkdtvv 421 fvnqwsvnhd plkwpnpenf dparfldkdg linkdltsry mifsvgkrrc igeelskmql 481 flfisilahq cdfranpnep akmnfsyglt ikpksfkvnv tlresmelld savqnlqake 541 tcq
```

Epidermal growth factor receptor, isoform a precursor NP_005219.2
(SEQ ID NO: 222)

```
  1 mrpsgtagaa llallaalcp asraleekkv cqgtsnkltq lgtfedhfls lqrmfnncev 61 vlgnleityv qrnydlsflk tigevagyvl ialntverip lenlqiirgn myyensyala 121 vlsnydankt glkelpmrnl qeilhgavrf snnpalcnve siqwrdivss dflsnmsmdf 181 qnhlgscqkc dpscpngscw gageencqkl tkiicaqqcs grcrgkspsd cchnqcaagc 241 tgpresdclv crkfrdeatc kdtcpplmly npttyqmdvn pegkysfgat cvkkcprnyv 301 vtdhgscvra cgadsyemee dgvrckckce gpcrkvcngi gigefkdsls inatnikhfk 361 nctsisgdlh ilpvafrgds fthtppldpq eldilktvke itgflliqaw penrtdlhaf 421 enleiirgrt kqhgqfslav vslnitslgl rslkeisdgd viisgnknlc yantinwkkl 481 fgtsgqktki isnrgensck atgqvchalc spegcwgpep rdcvscrnvs rgrecvdkcn 541 llegeprefv enseciqchp eclpqamnit ctgrgpdnci qcahyidgph cvktcpagvm 601 genntivwky adaghvchlc hpnctygctg pglegcptng pkipsiatgm vgalllllvv 661 algiglfmrr rhivrkrtlr rllgerelve pltpsgeapn qallrilket efkkikvlgs 721 gafgtvykgl wipegekvki pvaikelrea tspkankeil deayvmasvd nphvcrllgi 781 cltstvqlit qlmpfgclld yvrehkdnig sqyllnwcvq iakgmnyled rrlvhrdlaa 841 rnvlvktpqh vkitdfglak llgaeekeyh aeggkvpikw malesilhri ythqsdvwsy 901 gvtvwelmtf gskpydgipa seissilekg erlpqppict idvymimvkc wmidadsrpk 961 freliiefsk mardpqrylv iqgdermhlp sptdsnfyra lmdeedmddv vdadeylipq 1021 qgffsspsts rtpllsslsa tsnnstvaci drnglqscpi kedsflqrys sdptgalted 1081 siddtflpvp eyinqsvpkr pagsvqnpvy hnqplnpaps rdphyqdphs tavgnpeyln 1141 tvqptcvnst fdspahwaqk gshqisldnp dyqqdffpke akpngifkgs taenaeylry 1201 apqssefiga
```

Epidermal growth factor receptor, isoform b precursor NP_958439.1
(SEQ ID NO: 223)

```
  1 mrpsgtagaa llallaalcp asraleekkv cqgtsnkltq lgtfedhfls lqrmfnncev 61 vlgnleityv qrnydlsflk tiqevagyvl ialntverip lenlqiirgn myyensyala 121 vlsnydankt glkelpmrnl qeilhgavrf snnpalcnve siqwrdivss dflsnmsmdf 181 qnhlgscqkc dpscpngscw gageencqkl tkiicaqqcs grcrgkspsd cchnqcaagc 241 tgpresdclv crkfrdeatc kdtcpplmly npttyqmdvn pegkysfgat cvkkcprnyv 301 vtdhgscvra cgadsyemee dgvrckckce gpcrkvcngi gigefkdsls inatnikhfk 361 nctsisgdlh ilpvafrgds fthtppldpq eldilktvke itgflliqaw penrtdlhaf 421 enleiirgrt kqhgqfslav vslnitslgl rslkeisdgd viisgnknlc yantinwkkl 481 fgtsgqktki isnrgensck atgqvchalc spegcwgpep rdcvscrnvs rgrecvdkcn
```

-continued

```
541 llegeprefv ensecigchp eclpqamnit ctgrgpdnci qcahyidgph cvktcpagvm 601 genntlvwky adaghvchlc hpnctygs
```

Epidermal growth factor receptor, isoform c precursor NP_958440.1
(SEQ ID NO: 224)

```
  1 mrpsgtagaa llallaalcp asraleekkv cqgtsnkltq lgtfedhfls lqrmfnncev 61 vlgnleityv qrnydlsflk tiqevagyvl ialntverip lenlqiirgn myyensyala 121 vlsnydankt glkelpmrnl qeilhgavrf snnpalcnve siqwrdivss dflsnmsmdf 181 qnhlgscqkc dpscpngscw gageencqkl tkiicaqqcs grcrgkspsd cchnqcaagc 241 tgpresdclv crkfrdeatc kdtcpplmly npttyqmdvn pegkysfgat cvkkcprnyv 301 vtdhgscvra cgadsyemee dgvrkckkce gpcrkvcngi gigefkdsls inatnikhfk 361 nctsisgdlh ilpvafrgds fthtppldpq eldilktvke itgls
```

Epidermal growth factor receptor, isoform d precursor NP_958441.1
(SEQ ID NO: 225)

```
  1 mrpsgtagaa llallaalcp asraleekkv cqgtsnkltq lgtfedhfls lqrmfnncev 61 vlgnleityv qrnydlsflk tiqevagyvl ialntverip lenlqiirgn myyensyala 121 vlsnydankt glkelpmrnl qeilhgavrf snnpalcnve siqwrdivss dflsnmsmdf 181 qnhlgscqkc dpscpngscw gageencqkl tkiicaqqcs grcrgkspsd cchnqcaagc 241 tgpresdclv crkfrdeatc kdtcpplmly npttyqmdvn pegkysfgat cvkkcprnyv 301 vtdhgscvra cgadsyemee dgvrkckkce gpcrkvcngi gigefkdsls inatnikhfk 361 nctsisgdlh ilpvafrgds fthtppldpq eldilktvke itgflliqaw penrtdlhaf 421 enleiirgrt kqhgqfslav vslnitslgl rslkeisdgd viisgnknlc yantinwkkl 481 fgtsgqktki isnrgensck atgqvchalc spegcwgpep rdcvscrnvs rgrecvdkcn 541 llegeprefv ensecigchp eclpqamnit ctgrgpdnci qcahyidgph cvktcpagvm 601 genntlvwky adaghvchlc hpnctygpgn eslkamlfcl fklsscnqsn dgsyshqsgs 661 paagesclgw ipsllpsefq lgwggcshlh awpsasviit assch
```

Epidermal growth factor receptor, isoform e precursor NP_001333826.1
(SEQ ID NO: 226)

```
  1 mrpsgtagaa llallaalcp asraleekkv cqgtsnkltq lgtfedhfls lqrmfnncev 61 vlgnleityv qrnydlsflk tiqevagyvl ialntverip lenlqiirgn myyensyala 121 vlsnydankt glkelpmrnl qgqkcdpscp ngscwgagee ncqkltkiic aqqcsgrcrg 181 kspsdcchnq caagctgpre sdclvcrkfr deatckdtcp plmlynptty qmdvnpegky 241 sfgatcvkkc prnyvvtdhg scvracgads yemeedgvrk ckkcegperk vcngigigef 301 kdslsinatn ikhfknctsi sgdlhilpva frgdsfthtp pldpqeldil ktvkeitgfl 361 liqawpenrt dlhafenlei irgrtkqhgq fslavvslni tslglrslke isdgdviisg 421 nknlcyanti nwkklfgtsg qktkiisnrg ensckatgqv chalcspegc wgpeprdcvs 481 crnvsrgrec vdkcnllege prefvensec iqchpeclpq amnitctgrg pdnqcicahy 541 idgphcvktc pagvmgennt lvwkyadagh vchlchpnct ygctgpgleg cptngpkips 601 iatgmvgall lllvvalgig lfmrrrhivr krtlrrllqe relvepltps geapnqallr 661 ilketefkki kvlgsgafgt vykglwipeg ekvkipvaik elreatspka nkeildeayv 721 masvdnphvc rllgicltst vglitqlmpf gclldyvreh kdnigsqyll nwcvqiakgm 781 nyledrrlvh rdlaarnvlv ktpqhvkitd fglakllgae ekeyhaeggk vpikwmales 841 ilhriythqs dvwsygvtvw elmtfgskpy dgipaseiss ilekgerlpq ppictidvym 901 imvkcwmida dsrpkfreli iefskmardp grylviggde rmhlpsptds nfyralmdee
```

```
 961 dmddvvdade ylipqqgffs spstsrtpll sslsatsnns tvacidrngl qscpikedsf 1021 lqryssdptg altedsiddt flpvpgewlv wkqscsstss thsaaaslqc psqvlppasp 1081 egetvadlqt q
```

Epidermal growth factor receptor, isoform f precursor NP_001333827.1
(SEQ ID NO: 227)

```
   1 mrpsgtagaa llallaalcp asraleekkv cqgtsnkltq lgtfedhfls lqrmfnncev 61 vlgnleityv qrnydlsflk tigevagyvl ialntverip lenlqiirgn myyensyala 121 vlsnydankt glkelpmrnl qeilhgavrf snnpalcnve siqwrdivss dflsnmsmdf 181 qnhlgscqkc dpscpngscw gageencqkl tkiicaqqcs grcrgkspsd cchnqcaagc 241 tgpresdclv crkfrdeatc kdtcpplmly npttyqmdvn pegkysfgat cvkkcprnyv 301 vtdhgscvra cgadsyemee dgvrkckkce gpcrkvcngi gigefkdsls inatnikhfk 361 nctsisgdlh ilpvafrgds fthtppldpq eldilktvke itgflliqaw penrtdlhaf 421 enleiirgrt kqhgqfslav vslnitslgl rslkeisdgd viisgnknlc yantinwkkl 481 fgtsgqktki isnrgensck atgqvchalc spegcwgpep rdcvscrnvs rgrecvdkcn 541 llegeprefv enseciqchp eclpqamnit ctgrgpdnci qcahyidgph cvktcpagvm 601 genntivwky adaghvchlc hpnctygctg pglegcptng pkipsiatgm vgallllvv 661 algiglfmrr rhivrkrtlr rllgerelve pltpsgeapn qallrilket efkkikvlgs 721 gafgtvykgl wipegekvki pvaikelrea tspkankeil deayvmasvd nphvcrllgi 781 cltstvglit qlmpfgclld yvrehkdnig sqyllnwcvq iakgmnyled rrlvhrdlaa 841 rnvlvktpqh vkitdfglak llgaeekeyh aeggkvpikw malesilhri ythqsdvwsy 901 gvtvwelmtf gskpydgipa seissilekg erlpqppict idvymimvkc wmidadsrpk 961 freliiefsk mardpqrylv iqgdermhlp sptdsnfyra lmdeedmddv vdadeylipq 1021 qgffsspsts rtpllsslsa tsnnstvaci drnglqscpi kedsflqrys sdptgalted 1081 siddtflpvp gewlvwkqsc sstssthsaa aslqcpsqvl ppaspegetv adlqtq
```

Epidermal growth factor receptor, isoform g precursor NP_001333828.1
(SEQ ID NO: 228)

```
   1 mrpsgtagaa llallaalcp asraleekkv cqgtsnkltq lgtfedhfls lqrmfnncev 61 vlgnleityv qrnydlsflk tigevagyvl ialntverip lenlqiirgn myyensyala 121 vlsnydankt glkelpmrnl qgqkcdpscp ngscwgagee ncqkltkiic aqqcsgrcrg 181 kspsdcchnq caagctgpre sdclvcrkfr deatckdtcp plmlynptty qmdvnpegky 241 sfgatcvkkc prnyvvtdhg scvracgads yemeedgvrk ckkcegperk vcngigigef 301 kdslsinatn ikhfknctsi sgdlhilpva frgdsfthtp pldpqeldil ktvkeitgfl 361 liqawpenrt dlhafenlei irgrtkqhgq fslavvslni tslglrslke isdgdviisg 421 nknlcyanti nwkklfgtsg qktkiisnrg ensckatgqv chalcspegc wgpeprdcvs 481 crnvsrgrec vdkcnllege prefvensec iqchpeclpq amnitctgrg pdnciqcahy 541 idgphcvktc pagvmgennt lvwkyadagh vchlchpnct ygctgpgleg cptngpkips 601 iatgmvgall lllvvalgig lfmrrrhivr krtlrrllqe relvepltps geapnqallr 661 ilketefkki kvlgsgafgt vykglwipeg ekvkipvaik elreatspka nkeildeayv 721 masvdnphvc rllgicltst vglitqlmpf gclldyvreh kdnigsqyll nwcvqiakgm 781 nyledrrlvh rdlaarnvlv ktpqhvkitd fglakllgae ekeyhaeggk vpikwmales 841 ilhriythqs dvwsygvtvw elmtfgskpy dgipaseiss ilekgerlpq ppictidvym 901 imvkcwmida dsrpkfreli iefskmardp grylviggde rmhlpsptds nfyralmdee 961 dmddvvdade ylipqqgffs spstsrtpll sslsatsnns tvacidrngl qscpikedsf
```

```
1021 lqryssdptg altedsiddt flpvpeyinq svpkrpagsv qnpvyhnqpl npapsrdphy 1081 qdphstavgn peylntvqpt cvnstfdspa hwaqkgshqi sldnpdyqqd ffpkeakpng 1141 ifkgstaena eylrvapqss efiga
```

Epidermal growth factor receptor, isoform h NP_001333829.1
(SEQ ID NO: 229)

```
   1 mfnncevvlg nleityvqrn ydlsflktiq evagyvlial ntveriplen lqiirgnmyy 61 ensyalavls nydanktglk elpmrnlqei lhgavrfsnn palcnvesiq wrdivssdfl 121 snmsmdfqnh lgscqkcdps cpngscwgag eencqkltki icaqqcsgrc rgkspsdcch 181 nqcaagctgp resdclvcrk frdeatckdt cpplmlynpt tyqmdvnpeg kysfgatcvk 241 kcprnyvvtd hgscvracga dsyemeedgv rckkcegpc rkvcngigig efkdslsina 301 tnikhfknct sisgdlhilp vafrgdsfth tppldpgeld ilktvkeitg flliqawpen 361 rtdlhafenl eiirgrtkqh gqfslavvsl nitslglrsl keisdgdvii sgnknlcyan 421 tinwkklfgt sgqktkiisn rgensckatg qvchalcspe gcwgpeprdc vscrnvsrgr 481 ecvdkcnlle geprefvens eciqchpecl pqamnitctg rgpdncigca hyidgphcvk 541 tcpagvmgen ntivwkyada ghvchlchpn ctygctgpgl egcptngpki psiatgmvga 601 llllllvvalg iglfmrrrhi vrkrtlrrll qerelveplt psgeapngal lrilketefk 661 kikvlgsgaf gtvykglwip egekvkipva ikelreatsp kankeildea yvmasvdnph 721 vcrllgiclt stvqlitqlm pfgclldyvr ehkdnigsqy llnwcvgiak gmnyledrrl 781 vhrdlaarnv lvktpqhvki tdfglakllg aeekeyhaeg gkvpikwmal esilhriyth 841 qsdvwsygvt vwelmtfgsk pydgipasei ssilekgerl pqppictidv ymimvkcwmi 901 dadsrpkfre liiefskmar dpqrylviqg dermhlpspt dsnfyralmd eedmddvvda 961 deylipqqgf fsspstsrtp llsslsatsn nstvacidrn glqscpiked sflqryssdp 1021 tgaltedsid dtflpvpeyi nqsvpkrpag svqnpvyhnq pinpapsrdp hyqdphstav 1081 gnpeylntvq ptcvnstfds pahwaqkgsh gisldnpdyq qdffpkeakp ngifkgstae 1141 naeylrvapq ssefiga
```

Epidermal growth factor receptor, isoform i precursor NP_001333870.1
(SEQ ID NO: 230)

```
   1 mrpsgtagaa llallaalcp asraleekkg nyvvtdhgsc vracgadsye meedgvrkck 61 kcegperkvc ngigigefkd slsinatnik hfknctsisg dlhilpvafr gdsfthtppl 121 dpqeldilkt vkeitgflli qawpenrtdl hafenleiir grtkqhgqfs lavvslnits 181 lglrslkeis dgdviisgnk nlcyantinw kklfgtsgqk tkiisnrgen sckatgqvch 241 alcspegcwg peprdcvscr nvsrgrecvd kcnllegepr efvenseciq chpeclpqam 301 nitctgrgpd nciqcahyid gphcvktcpa gvmgenntiv wkyadaghvc hlchpnctyg 361 ctgpglegcp tngpkipsia tgmvgallll lvvalgiglf mrrrhivrkr tlrrllgere 421 lvepltpsge apnqallril ketefkkikv lgsgafgtvy kglwipegek vkipvaikel 481 reatspkank eildeayvma svdnphvcrl lgicltstvq litqlmpfgc lldyvrehkd 541 nigsqyllnw cvqiakgmny ledrrlvhrd laarnvlvkt pqhvkitdfg lakllgaeek 601 eyhaeggkvp ikwmalesil hriythqsdv wsygvtvwel mtfgskpydg ipaseissil 661 ekgerlpqpp ictidvymim vkcwmidads rpkfreliie fskmardpqr ylviqgderm 721 hlpsptdsnf yralmdeedm ddvdadeyl ipqqgffssp stsrtpllss lsatsnnstv 781 acidrnglqs cpikedsflq ryssdptgal tedsiddtfl pvpeyingsv pkrpagsvqn
```

```
841 pvyhnqplnp apsrdphyqd phstavgnpe ylntvgptcv nstfdspahw aqkgshqisl 901 dnpdyqqdff pkeakpngif kgstaenaey lrvapqssef iga
```

Epithelial cell adhesion molecule NP_002345.2

(SEQ ID NO: 231)

```
  1 mappqvlafg lllaaatatf aaageecvce nyklavncfv nnnrqcqcts vgagntvics 61 klaakclvmk aemngsklgr rakpegalqn ndglydpdcd esglfkakqc ngtsmcwcvn 121 tagvrrtdkd teitcservr tywiiielkh karekpydsk slrtalqkei ttryqldpkf 181 itsilyennv itidlvqnss qktqndvdia dvayyfekdv kgeslfhskk mdltvngeql 241 dldpgqtliy yvdekapefs mqglkagvia vivvvviavv agivvlvisr kkrmakyeka 301 eikemgemhr elna
```

Ephrin type-A receptor 2, isoform 1 precursor NP_004422.2

(SEQ ID NO: 232)

```
  1 melqaaracf allwgcalaa aaaaqgkevv lldfaaagge lgwlthpygk gwdlmqnimn 61 dmpiymysvc nvmsgdqdnw lrtnwvyrge aerifielkf tvrdcnsfpg gasscketfn 121 lyyaesdldy gtnfqkrlft kidtiapdei tvssdfearh vklnveersv gpltrkgfyl 181 afqdigacva llsvrvyykk cpellqglah fpetiagsda pslatvagtc vdhavvppgg 241 eeprmhcavd gewlvpigqc lcgagyekve dacqacspgf fkfeasespc lecpehtlps 301 pegatscece egffrapqdp asmpctrpps aphyltavgm gakvelrwtp pqdsggredi 361 vysvtceqcw pesgecgpce asvrysepph gltrtsvtvs dlephmnytf tvearngvsg 421 lvtsrsfrta sysinqtepp kvrlegrstt slsyswsipp pqqsrvwkye vtyrkkgdsn 481 synvrrtegf svtlddlapd ttylvqvgal tgegggagsk vhefqtlspe gsgnlavigg 541 vavgvvlllv lagvgffihr rrknqrarqs pedvyfskse qlkplktyvd phtyedpnqa 601 vlkftteihp scvtrqkvig agefgevykg mlktssgkke vpvaiktlka gytekqrvdf 661 lgeagimgqf shhniirleg viskykpmmi iteymengal dkflrekdge fsvlqlvgml 721 rgiaagmkyl anmnyvhrdl aarnilvnsn lvckvsdfgl srvleddpea tyttsggkip 781 irwtapeais yrkftsasdv wsfgivmwev mtygerpywe lsnhevmkai ndgfrlptpm 841 dcpsaiyqlm mqcwqqerar rpkfadivsi ldklirapds lktladfdpr vsirlpstsg 901 segvpfrtvs ewlesikmqq ytehfmaagy taiekvvqmt nddikrigvr lpghqkriay 961 sllglkdqvn tvgipi
```

Ephrin type-A receptor 2, isoform 2 NP_001316019.1

(SEQ ID NO: 233)

```
  1 mqnimndmpi ymysvcnvms gdqdnwlrtn wvyrgeaeri fielkftvrd cnsfpggass 61 cketfnlyya esdldygtnf qkrlftkidt iapdeitvss dfearhvkln veersvgplt 121 rkgfylafqd igacvallsv rvyykkcpel lqglahfpet iagsdapsla tvagtcvdha 181 vvppggeepr mhcavdgewl vpigqclcqa gyekvedacq acspgffkfe asespclecp 241 ehtlpspega tsceceegff rapgdpasmp ctrppsaphy ltavgmgakv elrwtppqds 301 ggredivysv tceqcwpesg ecgpceasvr ysepphgltr tsvtvsdlep hmnytftvea 361 rngvsglvts rsfrtasysi nqteppkvrl egrsttslsv swsipppqqs rvwkyevtyr 421 kkgdsnsynv rrtegfsvtl ddlapdttyl vqvgalgteg qgagskvhef qtlspegsgn 481 laviggvavg vvlllvlagv gffihrrrkn grargspedv yfskseqlkp lktyvdphty 541 edpnqavlkf tteihpscvt rqkvigagef gevykgmlkt ssgkkevpva iktlkagyte 601 kqrvdflgea gimgqfshhn iirlegvisk ykpmmiitey mengaldkfl rekdgefsvl 661 qlvgmlrgia agmkylanmn yvhrdlaarn ilvnsnlvck vsdfglsrvl eddpeatytt
```

```
721 sggkipirwt apeaisyrkf tsasdvwsfg ivmwevmtyg erpywelsnh evmkaindgf 781 rlptpmdcps aiyqlmmqcw qqerarrpkf adivsildkl irapdslktl adfdprvsir 841 lpstsgsegv pfrtvsewle sikmqqyteh fmaagytaie kvvqmtnddi krigvrlpgh 901 qkriaysllg lkdqvntvgi pi
```

Receptor-tyrosine-protein kinase erbB-2, isoform a precursor
NP_004439.2
(SEQ ID NO: 234)

```
  1 melaalcrwg lllallppga astqvctgtd mklrlpaspe thldmlrhly qgcqvvqgnl 61 eltylptnas lsflqdiqev qgyvliahnq vrqvplqrlr ivrgtqlfed nyalavldng 121 dplnnttpvt gaspggalrel qlrslteilk ggvliqrnpq lcyqdtilwk difhknnqla 181 ltlidtnrsr achpcspmck gsrcwgesse dcqsltrtvc aggcarckgp lptdccheqc 241 aagctgpkhs dclaclhfnh sgicelhcpa lvtyntdtfe smpnpegryt fgascvtacp 301 ynylstdvgs ctlvcplhnq evtaedgtqr cekcskpcar vcyglmehl revravtsan 361 iqefagckki fgslaflpes fdgdpasnta plqpeqlqvf etleeitgyl yisawpdslp 421 dlsvfqnlqv irgrilhnga ysltlqglgi swlglrslre lgsglalihh nthlcfvhtv 481 pwdqlfrnph qallhtanrp edecvgegla chqlcarghc wgpgptqcvn csqflrggec 541 veecrvlqgl preyvnarhc lpchpecqpq ngsvtcfgpe adqcvacahy kdppfcvarc 601 psgvkpdlsy mpiwkfpdee gacqpcpinc thscvdlddk gcpaegrasp ltsiisavvg 661 illvvvlgvv fgilikrrqq kirkytmrrl lgetelvepl tpsgampnqa qmrilketel 721 rkvkvlgsga fgtvykgiwi pdgenvkipv aikvlrents pkankeilde ayvmagvgsp 781 yvsrllgicl tstvqlvtql mpygclldhv renrgrlgsq dllnwcmgia kgmsyledvr 841 lvhrdlaarn vlvkspnhvk itdfglarll dideteyhad ggkvpikwma lesilrrrft 901 hqsdvwsygv tvwelmtfga kpydgipare ipdllekger lpqppictid vymimvkcwm 961 idsecrprfr elvsefsrma rdpqrfvviq nedlgpaspl dstfyrslle dddmgdlvda 1021 eeylvpqqgf fcpdpapgag gmvhhrhrss strsgggdlt lglepseeea prsplapseg 1081 agsdvfdgdl gmgaakglqs lpthdpsplq rysedptvpl psetdgyvap ltcspqpeyv 1141 nqpdvrpqpp spregplpaa rpagatlerp ktlspgkngv vkdvfafgga venpeyltpq 1201 ggaapqphpp pafspafdnl yywdqdpper gappstfkgt ptaenpeylg ldvpv
```

Receptor-tyrosine-protein kinase erbB-2, isoform b NP_001005862.1
(SEQ ID NO: 235)

```
  1 mklrlpaspe thldmlrhly qgcqvvqgnl eltylptnas lsflqdiqev qgyvliahnq 61 vrqvplqrlr ivrgtqlfed nyalavldng dpinnttpvt gaspggalrel qlrslteilk 121 ggvliqrnpq lcyqdtilwk difhknnqla ltlidtnrsr achpcspmck gsrcwgesse 181 dcqsltrtvc aggcarckgp lptdccheqc aagctgpkhs dclaclhfnh sgicelhcpa 241 lvtyntdtfe smpnpegryt fgascvtacp ynylstdvgs ctivcplhnq evtaedgtqr 301 cekcskpcar vcyglmehl revravtsan igefagckki fgslaflpes fdgdpasnta 361 plqpeqlqvf etleeitgyl yisawpdslp dlsvfqnlqv irgrilhnga ysltlqglgi 421 swlglrslre lgsglalihh nthlcfvhtv pwdqlfrnph qallhtanrp edecvgegla 481 chqlcarghc wgpgptqcvn csqflrggec veecrvlqgl preyvnarhc lpchpecqpq 541 ngsvtcfgpe adqcvacahy kdppfcvarc psgvkpdlsy mpiwkfpdee gacqpcpinc 601 thscvdlddk gcpaeqrasp ltsiisavvg illvvvlgvv fgilikrrqq kirkytmrrl 661 lqetelvepl tpsgampnqa qmrilketel rkvkvlgsga fgtvykgiwi pdgenvkipv 721 aikvlrents pkankeilde ayvmagvgsp yvsrllgicl tstvqlvtql mpygclldhv
```

-continued

```
 781 renrgrlgsq dllnwcmqia kgmsyledvr lvhrdlaarn vlvkspnhvk itdfglarll 841 dideteyhad ggkvpikwma lesilrrrft hqsdvwsygv tvwelmtfga kpydgipare 901 ipdllekger lpqppictid vymimvkcwm idsecrprfr elvsefsrma rdpqrfvviq 961 nedlgpaspl dstfyrslle dddmgdlvda eeylvpqqgf fcpdpapgag gmvhhrhrss 1021 strsgggdlt lglepseeea prsplapseg agsdvfdgdl gmgaakglqs lpthdpsplq 1081 rysedptvpl psetdgyvap ltcspqpeyv nqpdvrpqpp spregplpaa rpagatlerp 1141 ktlspgkngv vkdvfafgga venpeyltpq ggaapqphpp pafspafdnl yywdqdpper 1201 gappstfkgt ptaenpeylg ldvpv
```

Receptor-tyrosine-protein kinase erbB-2, isoform c NP_001276865.1
(SEQ ID NO: 236)

```
   1 mprgswkpqv ctgtdmklrl paspethldm lrhlyqgcqv vqgnleltyl ptnaslsflq 61 diqevggyvl iahnqvrqvp lqrlrivrgt qlfednyala vldngdpinn ttpvtgaspg 121 glrelqlrsl teilkggvli grnpqlcyqd tilwkdifhk nnqlaltlid tnrsrachpc 181 spmckgsrcw gessedcqsl trtvcaggca rckgplptdc cheqcaagct gpkhsdclac 241 lhfnhsgice lhcpalvtyn tdtfesmpnp egrytfgasc vtacpynyls tdvgsctivc 301 plhnqevtae dgtqrcekcs kpcarvcygl gmehlrevra vtsanigefa gckkifgsla 361 flpesfdgdp asntaplqpe qlqvfetlee itgylyisaw pdslpdlsvf qnlqvirgri 421 lhngaysltl qglgiswlgl rslrelgsgl alihhnthlc fvhtvpwdql frnphqallh 481 tanrpedecv geglachqlc arghcwgpgp tqcvncsqfl rgqecveecr vlqglpreyv 541 narhclpchp ecqpqngsvt cfgpeadqcv acahykdppf cvarcpsgvk pdlsympiwk 601 fpdeegacqp cpincthscv dlddkgcpae qraspltsii savvgillvv vlgvvfgili 661 krrqqkirky tmrrllqete lvepltpsga mpnqaqmril ketelrkvkv lgsgafgtvy 721 kgiwipdgen vkipvaikvl rentspkank eildeayvma gvgspyvsrl lgicltstvq 781 lvtqlmpygc lldhvrenrg rlgsqdllnw cmgiakgmsy ledvrlvhrd laarnvlvks 841 pnhvkitdfg larlldidet eyhadggkvp ikwmalesil rrrfthqsdv wsygvtvwel 901 mtfgakpydg ipareipdll ekgerlpqpp ictidvymim vkcwmidsec rprfrelvse 961 fsrmardpqr fvviqnedlg paspldstfy rslledddmg dlvdaeeylv pqqgffcpdp 1021 apgaggmvhh rhrssstrsg ggdltlglep seeeaprspl apsegagsdv fdgdlgmgaa 1081 kglqslpthd psplqrysed ptvplpsetd gyvapltcsp qpeyvnqpdv rpqppspreg 1141 plpaarpaga tlerpktlsp gkngvvkdvf afggavenpe yltpqggaap qphpppafsp 1201 afdnlyywdq dppergapps tfkgtptaen peylgldvpv
```

Receptor-tyrosine-protein kinase erbB-2, isoform d NP_001276866.1
(SEQ ID NO: 237)

```
   1 melaalcrwg lllallppga astqvctgtd mklrlpaspe thldmlrhly qgcqvvqgnl 61 eltylptnas lsflqdiqev qgyvliahnq vrqvplqrlr ivrgtqlfed nyalavldng 121 dplnnttpvt gaspgglrel qlrslteilk ggvliqrnpq lcyqdtilwk difhknnqla 181 ltlidtnrsr achpcspmck gsrcwgesse dcqsltrtvc aggcarckgp lptdccheqc 241 aagctgpkhs dclaclhfnh sgicelhcpa lvtyntdtfe smpnpegryt fgascvtacp 301 ynylstdvgs ctlvcplhnq evtaedgtqr cekcskpcar vcyglgmehl revravtsan 361 iqefagckki fgslaflpes fdgdpasnta plqpeqlqvf etleeitgyl yisawpdslp 421 dlsvfqnlqv irgrilhnga ysltlqglgi swlglrslre lgsglalihh nthlcfvhtv 481 pwdqlfrnph qallhtanrp edecvgegla chqlcarghc wgpgptqcvn csqflrggec 541 veecrvlqgl preyvnarhc lpchpecqpq ngsvtcfgpe adqcvacahy kdppfcvarc
```

-continued

```
  601 psgvkpdlsy mpiwkfpdee gacqpcpinc thscvdlddk gcpaegrasp ltsiisavvg
  661 illvvvlgvv fgilikrrqq kirkytmrrl lgetelvepl tpsgampnqa qmrilketel
  721 rkvkvlgsga fgtvykgiwi pdgenvkipv aikvlrents pkankeilde ayvmagvgsp
  781 yvsrllgicl tstvqlvtql mpygclldhv renrgrlgsq dllnwcmgia kgmsyledvr
  841 lvhrdlaarn vlvkspnhvk itdfglarll dideteyhad ggkvpikwma lesilrrrft
  901 hqsdvwsygv tvwelmtfga kpydgipare ipdllekger lpqppictid vymimvkcwm
  961 idsecrprfr elvsefsrma rdpqrfvviq nedlgpaspl dstfyrslle dddmgdlvda
 1021 eeylvpqqgf fcpdpapgag gmvhhrhrss strnm
```

Receptor-tyrosine-protein kinase erbB-2, isoform e NP_001276867.1
(SEQ ID NO: 238)

```
    1 mklrlpaspe thldmlrhly qgcqvvqgnl eltylptnas lsflqdiqev qgyvliahnq
   61 vrqvplqrlr ivrgtqlfed nyalavldng dpinnttpvt gaspgglrel qlrslteilk
  121 ggvliqrnpq lcyqdtilwk difhknnqla ltlidtnrsr achpcspmck gsrcwgesse
  181 dcqsltrtvc aggcarckgp lptdccheqc aagctgpkhs dclaclhfnh sgicelhcpa
  241 lvtyntdtfe smpnpegryt fgascvtacp ynylstdvgs ctivcplhnq evtaedgtqr
  301 cekcskpcar vcyglgmehl revravtsan igefagckki fgslaflpes fdgdpasnta
  361 plqpeqlqvf etleeitgyl yisawpdslp dlsvfqnlqv irgrilhnga ysltlqglgi
  421 swlglrslre lgsglalihh nthlcfvhtv pwdqlfrnph qallhtanrp edecvgegla
  481 chqlcarghc wgpgptqcvn csqflrggec veecrvlqgl preyvnarhc lpchpecqpq
  541 ngsvtcfgpe adqcvacahy kdppfcvarc psgvkpdlsy mpiwkfpdee gacqpcpinc
  601 ths
```

Receptor tyrosine-protein kinase erbB-4, isoform 3M-a/CVT-1
precursor NP_005226.1
(SEQ ID NO: 239)

```
    1 mkpatglwvw vsllvaagtv gpsdsgsvca gtenklssls dleqqyralr kyyencevvm
   61 gnleitsieh nrdlsflrsv revtgyvlva lnqfrylple nlriirgtkl yedryalaif
  121 lnyrkdgnfg lqelglknit eilnggvyvd qnkflcyadt ihwqdivrnp wpsnitivst
  181 ngssgcgrch ksctgrcwgp tenhcqtltr tvcaeqcdgr cygpyvsdcc hrecaggcsg
  241 pkdtdcfacm nfndsgacvt qcpqtfvynp ttfqlehnfn akytygafcv kkcphnfvvd
  301 ssscvracps skmeveengi kmckpctdic pkacdgigtg slmsaqtvds snidkfinct
  361 kingnliflv tgihgdpyna ieaidpekln vfrtvreitg flniqswppn mtdfsvfsnl
  421 vtiggrvlys glsllilkqq gitslqfqsl keisagniyi tdnsnlcyyh tinwttlfst
  481 inqrivirdn rkaenctaeg mvcnhlcssd gcwgpgpdqc lscrrfsrgr iciescnlyd
  541 gefrefengs icvecdpqce kmedglltch gpgpdnctkc shfkdgpncv ekcpdglqga
  601 nsfifkyadp drechpchpn ctqgcngpts hdciyypwtg hstlpqhart pliaagvigg
  661 lfilvivglt favyvrrksi kkkralrrfl etelvepltp sgtapnqaql rilketelkr
  721 vkvlgsgafg tvykgiwvpe getvkipvai kilnettgpk anvefmdeal imasmdhphl
  781 vrllgvclsp tiqlvtqlmp hgclleyvhe hkdnigsqll lnwcvqiakg mmyleerrlv
  841 hrdlaarnvl vkspnhvkit dfglarlleg dekeynadgg kmpikwmale cihyrkfthq
  901 sdvwsygvti welmtfggkp ydgiptreip dllekgerlp qppictidvy mvmvkcwmid
  961 adsrpkfkel aaefsrmard pqrylviqgd drmklpspnd skffqnllde edledmmdae
 1021 eylvpqafni pppiytsrar idsnrseigh spppaytpms gnqfvyrdgg faaeqgvsvp
 1081 yraptstipe apvaqgatae ifddsccngt lrkpvaphvg edsstqrysa dptvfapers
```

-continued

```
1141 prgeldeegy mtpmrdkpkq eylnpveenp fvsrrkngdl galdnpeyhn asngppkaed
1201 eyvneplyln tfantlgkae ylknnilsmp ekakkafdnp dywnhslppr stlqhpdylq
1261 eystkyfykq ngrirpivae npeylsefsl kpgtvlpppp yrhrntvv
```

Receptor tyrosine-protein kinase erbB-4, isoform JM-a/CVT-2
precursor NP_001036064.1

(SEQ ID NO: 240)
```
   1 mkpatglwvv vsllvaagtv gpsdsgsvca gtenklssls dleqqyralr kyyencevvm
  61 gnleitsieh nrdlsflrsv revtgyvlva lnqfrylple nlriirgtkl yedryalaif
 121 lnyrkdgnfg lqelglknit eilnggvyvd qnkflcyadt ihwqdivrnp wpsnitivst
 181 ngssgcgrch ksctgrcwgp tenhcqtltr tvcaeqcdgr cygpyvsdcc hrecaggcsg
 241 pkdtdcfacm nfndsgacvt qcpqtfvynp ttfqlehnfn akytygafcv kkcphnfvvd
 301 ssscvracps skmeveengi kmckpctdic pkacdgigtg slmsaqtvds snidkfinct
 361 kingnliflv tgihgdpyna ieaidpekln vfrtvreitg flniqswppn mtdfsvfsnl
 421 vtiggrvlys glsllilkqq gitslqfqsl keisagniyi tdnsnlcyyh tinwttlfst
 481 inqrivirdn rkaenctaeg mvcnhlcssd gcwgpgpdqc lscrrfsrgr iciescnlyd
 541 gefrefengs icvecdpqce kmedglltch gpgpdnctkc shfkdgpncv ekcpdglqga
 601 nsfifkyadp drechpchpn ctqgcngpts hdciyypwtg hstlpqhart pliaagvigg
 661 lfilvivglt favyvrrksi kkkralrrfl etelvepltp sgtapnqaql rilketelkr
 721 vkvlgsgafg tvykgiwvpe getvkipvai kilnettgpk anvefmdeal imasmdhphl
 781 vrllgvclsp tiqlvtqlmp hgclleyvhe hkdnigsqll lnwcvqiakg mmyleerrlv
 841 hrdlaarnvl vkspnhvkit dfglarlleg dekeynadgg kmpikwmale cihyrkfthq
 901 sdvwsygvti welmtfggkp ydgiptreip dllekgerlp qppictidvy mvmvkcwmid
 961 adsrpkfkel aaefsrmard pqrylviqgd drmklpspnd skffqnllde edledmmdae
1021 eylvpqafni pppiytsrar idsnrnqfvy rdggfaaeqg vsvpyrapts tipeapvaqg
1081 ataeifddsc cngtlrkpva phvgedsstq rysadptvfa persprgeld eegymtpmrd
1141 kpkqeylnpv eenpfvsrrk ngdlqaldnp eyhnasngpp kaedeyvnep lylntfantl
1201 gkaeylknni lsmpekakka fdnpdywnhs lpprstlqhp dylgeystky fykqngrirp
1261 ivaenpeyls efslkpgtvl ppppyrhrnt vv
```

Prolyl endopeptidase FAP, isoform 1 NP_004451.2

(SEQ ID NO: 241)
```
   1 mktwvkivfg vatsavlall vmcivlrpsr vhnseentmr altlkdilng tfsyktffpn
  61 wisgqeylhq sadnnivlyn ietgqsytil snrtmksvna snyglspdrq fvylesdysk
 121 lwrysytaty yiydlsngef vrgnelprpi gylcwspvgs klayvyqnni ylkgrpgdpp
 181 fqitfngren kifngipdwv yeeemlatky alwwspngkf layaefndtd ipviaysyyg
 241 deqyprtini pypkagaknp vvrifiidtt ypayvgpqev pvpamiassd yyfswltwvt
 301 dervclqwlk rvqnvsvlsi cdfredwqtw dcpktgehie esrtgwaggf fvstpvfsyd
 361 aisyykifsd kdgykhihyi kdtvenaiqi tsgkweaini frvtqdslfy ssnefeeypg
 421 rrniyrisig syppskkcvt chlrkercqy ytasfsdyak yyalvcygpg ipistlhdgr
 481 tdqeikilee nkelenalkn iqlpkeeikk levdeitlwy kmilppqfdr skkyplliqv
 541 yggpcsqsvr svfavnwisy laskegmvia lvdgrgtafq gdkllyavyr klgvyevedq
 601 itavrkfiem gfidekriai wgwsyggyvs slalasgtgl fkcgiavapv ssweyyasvy
 661 terfmglptk ddnlehykns tvmaraeyfr nvdyllihgt addnvhfqns aqiakalvna
 721 qvdfqamwys dqnhglsgls tnhlythmth flkqcfslsd
```

-continued

Prolyl endopeptidase FAP, isoform 2 NP_001278736.1
(SEQ ID NO: 242)
```
  1 mktwvkivfg vatsavlall vmcivlrpsr vhnseentmr altlkdilng tfsyktffpn
 61 wisgqeylhq sadnnivlyn ietgqsytil snrtmlwrys ytatyyiydl sngefvrgne
121 lprpiqylcw spvgsklayv yqnniylkqr pgdppfqitf ngrenkifng ipdwvyeeem
181 latkyalwws pngkflayae fndtdipvia ysyygdeqyp rtinipypka gaknpvvrif
241 iidttypayv gpqevpvpam iassdyyfsw ltwvtdervc lqwlkrvqnv svlsicdfre
301 dwqtwdcpkt gehieesrtg waggffvstp vfsydaisyy kifsdkdgyk hihyikdtve
361 naiqitsgkw eainifrvtq dslfyssnef eeypgrrniy risigsypps kkcvtchlrk
421 ercqyytasf sdyakyyalv cygpgipist lhdgrtdgei kileenkele nalkniqlpk
481 eeikklevde itlwykmilp pqfdrskkyp lliqvyggpc sgsvrsvfav nwisylaske
541 gmvialvdgr gtafqgdkll yavyrklgvy evedgitavr kfiemgfide kriaiwgwsy
601 ggyvsslala sgtglfkcgi avapsswey yasvyterfm glptkddnle hyknstvmar
661 aeyfrnvdyl lihgtaddnv hfqnsagiak alvnaqvdfq amwysdqnhg lsglstnhly
721 thmthflkqc fslsd
```

Glutamate carboxypeptidase 2, isoform 1 NP_004467.1
(SEQ ID NO: 243)
```
  1 mwnllhetds avatarrprw lcagalvlag gffllgflfg wfikssneat nitpkhnmka
 61 fldelkaeni kkflynftqi phlagteqnf glakqiqsqw kefgldsvel ahydvllsyp
121 nkthpnyisi inedgneifn tslfeppppg yenvsdivpp fsafspqgmp egdlvyvnya
181 rtedffkler dmkincsgki viarygkvfr gnkvknagla gakgvilysd padyfapgvk
241 sypdgwnlpg ggvqrgniln lngagdpltp gypaneyayr rgiaeavglp sipvhpigyy
301 daqkllekmg gsappdsswr gslkvpynvg pgftgnfstq kvkmhihstn evtriynvig
361 tlrgavepdr yvilgghrds wvfggidpqs gaavvheivr sfgtlkkegw rprrtilfas
421 wdaeefgllg stewaeensr llgergvayi nadssiegny tlrvdctplm yslvhnitke
481 lkspdegfeg kslyeswtkk spspefsgmp risklgsgnd fevffqrlgi asgrarytkn
541 wetnkfsgyp lyhsvyetye lvekfydpmf kyhltvaqvr ggmvfelans ivlpfdcrdy
601 avvlrkyadk iysismkhpq emktysysfd slfsavknft eiaskfserl qdfdksnpiv
661 lrmmndqlmf lerafidplg lpdrpfyrhv iyapsshnky agesfpgiyd alfdieskvd
721 pskawgevkr qiyvaaftvq aaaetlseva
```

Glutamate carboxypeptidase 2, isoform 2 NP_001014986.1
(SEQ ID NO: 244)
```
  1 mwnllhetds avatarrprw lcagalvlag gffllgflfg wfikssneat nitpkhnmka
 61 fldelkaeni kkflynftqi phlagteqnf glakqiqsqw kefgldsvel ahydvllsyp
121 nkthpnyisi inedgneifn tslfeppppg yenvsdivpp fsafspqgmp egdlvyvnya
181 rtedffkler dmkincsgki viarygkvfr gnkvknagla gakgvilysd padyfapgvk
241 sypdgwnlpg ggvqrgniln lngagdpltp gypaneyayr rgiaeavglp sipvhpigyy
301 daqkllekmg gsappdsswr gslkvpynvg pgftgnfstq kvkmhihstn evtriynvig
361 tlrgavepdr yvilgghrds wvfggidpqs gaavvheivr sfgtlkkegw rprrtilfas
421 wdaeefgllg stewaeensr llgergvayi nadssiegny tlrvdctplm yslvhnitke
481 lkspdegfeg kslyeswtkk spspefsgmp risklgsgnd fevffqrlgi asgrarytkn
541 wetnkfsgyp lyhsvyetye lvekfydpmf kyhltvaqvr ggmvfelans ivlpfdcrdy
```

-continued

```
601 avvlrkyadk iysismkhpq emktysysfd slfsavknft eiaskfserl qdfdkskhvi 661 yapsshnkya gesfpgiyda lfdieskvdp skawgevkrq iyvaaftvqa aaetlseva
```

Glutamate carboxypeptidase 2, isoform 3 NP_001180400.1
(SEQ ID NO: 245)

```
  1 mtagssyplf laayactgcl aerlgwfiks sneatnitpk hnmkafldel kaenikkfly 61 nftqiphlag teqnfqlakq iqsqwkefgl dsvelahydv llsypnkthp nyisiinedg 121 neifntslfe ppppgyenvs divppfsafs pqgmpegdlv yvnyartedf fklerdmkin 181 csgkiviary gkvfrgnkvk naglagakgv ilysdpadyf apgvksypdg wnlpgggvqr 241 gnilnlngag dpltpgypan eyayrrgiae avglpsipvh pigyydaqkl lekmggsapp 301 dsswrgslkv pynvgpgftg nfstqkvkmh ihstnevtri ynvigtlrga vepdryvilg 361 ghrdswvfgg idpqsgaavv heivrsfgtl kkegwrprrt ilfaswdaee fgllgstewa 421 eensrllqer gvayinadss iegnytlrvd ctplmyslvh nitkelkspd egfegkslye 481 swtkkspspe fsgmpriskl gsgndfevff qrlgiasgra rytknwetnk fsgyplyhsv 541 yetyelvekf ydpmfkyhlt vaqvrggmvf elansivlpf dcrdyavvlr kyadkiysis 601 mkhpqemkty svsfdslfsa vknfteiask fserlqdfdk snpivlrmmn dqlmfleraf 661 idplglpdrp fyrhviyaps shnkyagesf pgiydalfdi eskvdpskaw gevkrqiyva 721 aftvqaaaet lseva
```

Glutamate carboxypeptidase 2, isoform 4 NP_001180401.1
(SEQ ID NO: 246)

```
  1 mtagssyplf laayactgcl aerlgwfiks sneatnitpk hnmkafldel kaenikkfly 61 nftqiphlag teqnfqlakq iqsqwkefgl dsvelahydv llsypnkthp nyisiinedg 121 neifntslfe ppppgyenvs divppfsafs pqgmpegdlv yvnyartedf fklerdmkin 181 csgkiviary gkvfrgnkvk naglagakgv ilysdpadyf apgvksypdg wnlpgggvqr 241 gnilnlngag dpltpgypan eyayrrgiae avglpsipvh pigyydaqkl lekmggsapp 301 dsswrgslkv pynvgpgftg nfstqkvkmh ihstnevtri ynvigtlrga vepdryvilg 361 ghrdswvfgg idpqsgaavv heivrsfgtl kkegwrprrt ilfaswdaee fgllgstewa 421 eensrllqer gvayinadss iegnytlrvd ctplmyslvh nitkelkspd egfegkslye 481 swtkkspspe fsgmpriskl gsgndfevff qrlgiasgra rytknwetnk fsgyplyhsv 541 yetyelvekf ydpmfkyhlt vaqvrggmvf elansivlpf dcrdyavvlr kyadkiysis 601 mkhpqemkty svsfdslfsa vknfteiask fserlqdfdk skhviyapss hnkyagesfp 661 giydalfdie skvdpskawg evkrqiyvaa ftvgaaaetl seva
```

Glutamate carboxypeptidase 2, isoform 5 NP_001180402.1
(SEQ ID NO: 247)

```
  1 mggsappdss wrgslkvpyn vgpgftgnfs tqkvkmhihs tnevtriynv igtlrgavep 61 dryvilgghr dswvfggidp qsgaavvhei vrsfgtlkke gwrprrtilf aswdaeefgl 121 lgstewaeen srllqergva yinadssieg nytlrvdctp lmyslvhnit kelkspdegf 181 egkslyeswt kkspspefsg mprisklgsg ndfevffqrl giasgraryt knwetnkfsg 241 yplyhsvyet yelvekfydp mfkyhltvaq vrggmvfela nsivlpfdcr dyavvlrkya 301 dkiysismkh pqemktysys fdslfsavkn fteiaskfse rlqdfdksnp ivlrmmndql 361 mflerafidp lglpdrpfyr hviyapsshn kyagesfpgi ydalfdiesk vdpskawgev 421 krqiyvaaft vqaaaetlse va
```

Glutamate carboxypeptidase 2, isoform 6 NP_001338165.1
(SEQ ID NO: 248)

```
  1 mkafldelka enikkflynf tqiphlagte qnfglakqiq sqwkefglds velahydvll
```

```
 61 sypnkthpny isiinedgne ifntslfepp ppgyenvsdi vppfsafspq gmpegdlvyv 121 nyartedffk lerdmkincs gkiviarygk vfrgnkvkna qlagakgvil ysdpadyfap 181 gvksypdgwn lpgggvqrgn ilnlngagdp ltpgypaney ayrrgiaeav glpsipvhpi 241 gyydaqklle kmggsappds swrgslkvpy nvgpgftgnf stqkvkmhih stnevtriyn 301 vigtlrgave pdryvilggh rdswvfggid pqsgaavvhe ivrsfgtlkk egwrprrtil 361 faswdaeefg llgstewaee nsrllgergv ayinadssie gnytlrvdct plmyslvhnl 421 tkelkspdeg fegkslyesw tkkspspefs gmprisklgs gndfevffqr lgiasgrary 481 tknwetnkfs gyplyhsvye tyelvekfyd pmfkyhltva qvrggmvfel ansivlpfdc 541 rdyavvlrky adkiysismk hpqemktysv sfdslfsavk nfteiaskfs erlqdfdksk 601 hviyapsshn kyagesfpgi ydalfdiesk vdpskawgev krqiyvaaft vqaaaetlse 661 va
```

Fos-related antigen 1, isoform 1 NP_005429.1
(SEQ ID NO: 249)
```
  1 mfrdfgepgp ssgngggygg paqppaaaqa aqqkfhlvps intmsgsgel qwmvqphflg 61 pssyprplty pqysppqprp gviralgppp gvrrrpceqi speeeerrry rrernklaaa 121 kcrnrrkelt dflqaetdkl edeksglgre ieelqkqker lelvleahrp ickipegake 181 gdtgstsgts sppaperpvp cislspgpvl epealhtptl mttpsltpft pslvftypst 241 pepcasahrk sssssgdpss dplgsptlla l
```

Fos-related antigen 1, isoform 2 NP_001287773.1
(SEQ ID NO: 250)
```
  1 mfrdfgepgp ssgngggygg paqppaaaqa aqqkfhlvps intmsgsgel qwmvqphflg 61 pssyprplty pqysppqprp gviralgppp gvrrrpceqe tdkledeksg lgreieelqk 121 qkerlelvle ahrpickipe gakegdtgst sgtssppapc rpvpcislsp gpvlepealh 181 tptlmttpsl tpftpslvft ypstpepcas ahrkssssg dpssdplgsp tllal
```

Fos-related antigen 1, isoform 3 NP_001287784.1
(SEQ ID NO: 251)
```
  1 mfrdfgepgp ssgngggygg paqppaaaqa aqqkfhlvps intmsgsgel qwmvqphflg 61 pssyprplty pqysppqprp gviralgppp gvrrrpceqp ggrgappska raegagcgqv 121 qepeegtdrl paggd
```

Fos-related antigen 1, isoform 4 NP_001287785.1
(SEQ ID NO: 252)
```
  1 mfrdfgepgp ssgngggygg paqppaaaqa aggispeeee rrrvrrernk laaakcrnrr 61 keltdflqae tdkledeksg lgreieelqk qkerlelvle ahrpickipe gakegdtgst 121 sgtssppapc rpvpcislsp gpvlepealh tptlmttpsl tpftpslvft ypstpepcas 181 ahrkssssg dpssdplgsp tllal
```

Fos-related antigen 1, isoform 5 NP_001287786.1
(SEQ ID NO: 253)
```
  1 mfrdfgepgp ssgngggygg paqppaaaqa aqqetdkled eksglgreie elqkqkerle 61 lvleahrpic kipegakegd tgstsgtssp paperpvpci slspgpvlep ealhtptlmt 121 tpsltpftps lvftypstpe pcasahrkss sssgdpssdp lgsptllal
```

G antigen 1 NP_001035753.1
(SEQ ID NO: 254)
```
  1 mswrgrstyy wprprryvqp pemigpmrpe qfsdevepat peegepatqr gdpaaaqege 61 degasagqgp kpeadsgeqg hpqtgceced gpdgqemdpp npeevktpee geggsqc
```

G antigen 12I NP_001465.1
(SEQ ID NO: 255)
```
  1 mswrgrstyy wprprryvqp pemigpmrpe qfsdevepat peegepatqr gdpaaaqege 61 degasagqgp kpeadsgeqg hpqtgceced gpdgqemdpp npeevktpee gekqsqc
```

Galectin-1 NP_002296.1

(SEQ ID NO: 256)

```
  1 macglvasnl nlkpgeclry rgevapdaks fvinlgkdsn nlclhfnprf nahgdantiv
 61 cnskdggawg tegreavfpf qpgsvaevci tfdqanitvk lpdgyefkfp nrinleainy
121 maadgdfkik cvafd
```

Galectin-3 isoform 1 NP_002297.2

(SEQ ID NO: 257)

```
  1 madnfslhda lsgsgnpnpq gwpgawgnqp agaggypgas ypgaypgqap pgaypgqapp
 61 gaypgapgay pgapapgvyp gppsgpgayp ssgqpsatga ypatgpygap agplivpynl
121 plpggvvprm litilgtvkp nanrialdfq rgndvafhfn prfnennrry ivcntkldnn
181 wgreerqsvf pfesgkpfki qvlvepdhfk vavndahllq ynhrvkklne isklgisgdi
241 dltsasytmi
```

Galectin-3, isoform 3 NP_001344607.1

(SEQ ID NO: 258)

```
  1 mhsktpcgcf kpwkmadnfs lhdalsgsgn pnpqgwpgaw gnqpagaggy pgasypgayp
 61 gqappgaypg qappgaypga pgaypgapap gvypgppsgp gaypssgqps atgaypatgp
121 ygapagpliv pynlplpggv vprmlitilg tvkpnanria ldfqrgndva fhfnprfnen
181 nrrvivcntk ldnnwgreer qsvfpfesgk pfkiqvlvep dhfkvavnda hllqynhrvk
241 klneisklgi sgdidltsas ytmi
```

Galectin-9 short NP_002299.2

(SEQ ID NO: 259)

```
  1 mafsgsqapy lspavpfsgt iqgglqdglq itvngtvlss sgtrfavnfq tgfsgndiaf
 61 hfnprfedgg yvvcntrqng swgpeerkth mpfqkgmpfd lcflvqssdf kvmvngilfv
121 qyfhrvpfhr vdtisvngsv qlsyisfqpp gvwpanpapi tqtvihtvqs apgqmfstpa
181 ippmmyphpa ypmpfittil gglypsksil lsgtvlpsaq rfhinlcsgn hiafhlnprf
241 denavvrntq idnswgseer slprkmpfvr gqsfsvwilc eahclkvavd gqhlfeyyhr
301 lrnlptinrl evggdiqlth vqt
```

Galectin-9 long NP_033665.1

(SEQ ID NO: 260)

```
  1 mafsgsqapy lspavpfsgt iqgglqdglq itvngtvlss sgtrfavnfq tgfsgndiaf
 61 hfnprfedgg yvvcntrqng swgpeerkth mpfqkgmpfd lcflvqssdf kvmvngilfv
121 qyfhrvpfhr vdtisvngsv qlsyisfqnp rtvpvqpafs tvpfsqpvcf pprprgrrqk
181 ppgvwpanpa pitqtvihtv qsapgqmfst paippmmyph paypmpfitt ilgglypsks
241 illsgtvlps aqrfhinlcs gnhiafhlnp rfdenavvrn tqidnswgse erslprkmpf
301 vrgqsfsvwi lceahclkva vdgqhlfeyy hrlrnlptin rlevggdiql thvqt
```

Galectin-9 isoform 3 NP_001317092.1

(SEQ ID NO: 261)

```
  1 mafsgsqapy lspavpfsgt iqgglqdglq itvngtvlss sgtrfavnfq tgfsgndiaf
 61 hfnprfedgg yvvcntrqng swgpeerkth mpfqkgmpfd lcflvqssdf kvmvngilfv
121 qyfhrvpfhr vdtisvngsv qlsyisfqpp gvwpanpapi tqtvihtvqs apgqmfstpa
181 ippmmyphpa ypmpfittil gglypsksil lsgtvlpsaq rcgscvklta srwpwmvstc
241 lnttia
```

Premelanosome protein, isoform 1 preprotein NP_001186983.1

(SEQ ID NO: 262)

```
  1 mdlvlkrcll hlavigalla vgatkvprnq dwlgvsrqlr tkawnrglyp ewteaqrldc
 61 wrggqvslkv sndgptliga nasfsialnf pgsqkvlpdg qviwvnntii ngsqvwggqp
121 vypqetddac ifpdggpcps gswsqkrsfv yvwktwgqyw qvlggpvsgl sigtgramlg
```

-continued

```
181 thtmevtvyh rrgsrsyvpl ahsssaftit dqvpfsysys qlraldggnk hflrnqpltf 241 alqlhdpsgy laeadlsytw dfgdssgtli sralvvthty lepgpvtaqv vlqaaiplts 301 cgsspvpgtt dghrptaeap nttagqvptt evvgttpgqa ptaepsgtts vqvpttevis 361 tapvqmptae stgmtpekvp vsevmgttla emstpeatgm tpaevsivvl sgttaaqvtt 421 tewvettare lpipepegpd assimstesi tgslgplldg tatlrlvkrq vpldcvlyry 481 gsfsvtldiv qgiesaeilq avpsgegdaf eltvscqggl pkeacmeiss pgcqppagrl 541 cqpvlpspac qlvlhqilkg gsgtyclnvs ladtnslavv stqlimpvpg illtggeagl 601 gqvplivgil lvlmavvlas liyrrrlmkg dfsvpqlphs sshwlrlpri fcscpigens 661 pllsgqqv
```

Premelanosome protein, isoform 2 precursor NP_001186982.1
(SEQ ID NO: 263)
```
  1 mdlvlkrcll hlavigalla vgatkgsqvw gggpvypget ddacifpdgg pcpsgswsqk 61 rsfvyvwktw gqywqvlggp vsglsigtgr amlgthtmev tvyhrrgsrs yvplahsssa 121 ftitdqvpfs vsysqlrald ggnkhflrnq pltfalqlhd psgylaeadl sytwdfgdss 181 gtlisralvv thtylepgpv taqvvlqaai pltscgsspv pgttdghrpt aeapnttagq 241 vpttevvgtt pgqaptaeps gttsvqvptt evistapvqm ptaestgmtp ekvpvsevmg 301 ttlaemstpe atgmtpaevs ivvlsgttaa qvtttewvet tarelpipep egpdassims 361 tesitgslgp lldgtatlrl vkrqvpldcv lyrygsfsvt ldivggiesa eilqavpsge 421 gdafeltvsc qgglpkeacm eissspgcqpp aqrlcqpvlp spacqlvlhq ilkggsgtyc 481 lnvsladtns lavvstqlim pgqeaglgqv plivgillvl mavvlasliy rrrlmkqdfs 541 vpqlphsssh wlrlprifcs cpigenspll sgqqv
```

Premelanosome protein, isoform 3 preprotein NP_008859.1
(SEQ ID NO: 264)
```
  1 mdlvlkrcll hlavigalla vgatkvprnq dwlgvsrqlr tkawnrglyp ewteaqrldc 61 wrggqvslkv sndgptliga nasfsialnf pgsqkvlpdg qviwvnntii ngsqvwggqp 121 vypqetddac ifpdggpcps gswsqkrsfv yvwktwgqyw qvlggpvsgl sigtgramlg 181 thtmevtvyh rrgsrsyvpl ahsssaftit dqvpfsysys qlraldggnk hflrnqpltf 241 alqlhdpsgy laeadlsytw dfgdssgtli sralvvthty lepgpvtaqv vlqaaiplts 301 cgsspvpgtt dghrptaeap nttagqvptt evvgttpgqa ptaepsgtts vqvpttevis 361 tapvqmptae stgmtpekvp vsevmgttla emstpeatgm tpaevsivvl sgttaaqvtt 421 tewvettare lpipepegpd assimstesi tgslgplldg tatlrlvkrq vpldcvlyry 481 gsfsvtldiv qgiesaeilq avpsgegdaf eltvscqggl pkeacmeiss pgcqppagrl 541 cqpvlpspac qlvlhqilkg gsgtyclnvs ladtnslavv stglimpgge aglgqvpliv 601 gillvlmavv lasliyrrrl mkgdfsvpql phssshwlrl prifcscpig enspllsgqq 661 v
```

Premelanosome protein, isoform 4 preprotein NP_001307050.1
(SEQ ID NO: 265)
```
  1 mdlvlkrcll hlavigalla vgatkvprnq dwlgvsrqlr tkawnrglyp ewteaqrldc 61 wrggqvslkv sndgptliga nasfsialnf pgsqkvlpdg qviwvnntii ngsqvwggqp 121 vypqetddac ifpdggpcps gswsqkrsfv yvwktwgqyw qvlggpvsgl sigtgramlg 181 thtmevtvyh rrgsrsyvpl ahsssaftit dqvpfsysys qlraldggnk hflrnqpltf 241 alqlhdpsgy laeadlsytw dfgdssgtli sralvvthty lepgpvtaqv vlqaaiplts 301 cgsspvpgtt dghrptaeap nttagqvptt evvgttpgqa ptaepsgtts vqvpttevis 361 tapvqmptae staaqvttte wvettarelp ipepegpdas simstesitg slgplldgta
```

```
421 tlrlvkrqvp ldcvlyrygs fsvtldivqg iesaeilqav psgegdafel tvscqgglpk 481 eacmeisspg cqppaqrlcq pvlpspacql vlhqilkggs gtyclnvsla dtnslavvst 541 qlimpvpgil ltgqeaglgq vplivgillv lmavvlasli yrrrlmkqdf svpqlphsss 601 hwlrlprifc scpigenspl lsgqqv
```

Premelanosome protein, isoform 5 preprotein NP_001307051.1

(SEQ ID NO: 266)
```
  1 mdlvlkrcll hlavigalla vgatkvprnq dwlgvsrqlr tkawnrglyp ewteaqrldc 61 wrggqvslkv sndgptliga nasfsialnf pgsqkvlpdg qviwvnntii ngsqvwggqp 121 vypqetddac ifpdggpcps gswsqkrsfv yvwktwgqyw qvlggpvsgl sigtgramlg 181 thtmevtvyh rrgsrsyvpl ahsssaftit dqvpfsysys qlraldggnk hflrnqpltf 241 alqlhdpsgy laeadlsytw dfgdssgtli sralvvthty lepgpvtaqv vlqaaiplts 301 cgsspvpgtt dghrptaeap nttagqvptt evvgttpgqa ptaepsgtts vqvpttevis 361 tapvqmptae staaqvttte wvettarelp ipepegpdas simstesitg slgplldgta 421 tlrlvkrqvp ldcvlyrygs fsvtldivqg iesaeilqav psgegdafel tvscqgglpk 481 eacmeisspg cqppaqrlcq pvlpspacql vlhqilkggs gtyclnvsla dtnslavvst 541 qlimpggeag lgqvplivgi llvlmavvla sliyrrrlmk qdfsvpqlph sshwlrlpr 601 ifcscpigen spllsgqqv
```

Glutamate receptor ionotropic, NMDA 2A, isoform 1 precursor
NP_000824.1, NP_001127879.1

(SEQ ID NO: 267)
```
   1 mgrvgywtll vlpallvwrg papsaaaekg ppalniavml ghshdvtere lrtlwgpeqa 61 aglpldvnvv allmnrtdpk slithvcdlm sgarihglvf gddtdqeava qmldfissht 121 fvpilgihgg asmimadkdp tstffqfgas iqqqatvmlk imgdydwhvf slvttifpgy 181 refisfvktt vdnsfvgwdm qnvitldtsf edaktqvglk kihssvilly cskdeavlil 241 searslgltg ydffwivpsl vsgntelipk efpsglisys yddwdyslea rvrdgigilt 301 taassmlekf syipeakasc ygqmerpevp mhtlhpfmvn vtwdgkdlsf teegyqvhpr 361 lvvivinkdr ewekvgkwen htlslrhavw pryksfsdce pddnhlsivt leeapfvive 421 didpltetcv rntvperkfv kinnstnegm nvkkcckgfc idilkklsrt vkftydlylv 481 tngkhgkkvn nvwngmigev vyqravmavg sltineerse vvdfsvpfve tgisvmvsrs 541 ngtvspsafl epfsasvwvm mfvmllivsa iavfvfeyfs pvgynrnlak gkaphgpsft 601 igkaiwllwg lvfnnsvpvq npkgttskim vsvwaffavi flasytanla afmiqeefvd 661 qvtglsdkkf qrphdysppf rfgtvpngst ernirnnypy mhqymtkfnq kgvedalvsl 721 ktgkldafiy daavinykag rdegcklvti gsgyifattg ygialqkgsp wkrqidlall 781 qfvgdgemee letlwltgic hneknevmss qldidnmagv fymlaaamal slitfiwehl 841 fywklrfcft gvcsdrpgll fsisrgiysc ihgvhieekk kspdfnitgs qsnmlkllrs 901 aknissmsnm nssrmdspkr aadfigrgsl imdmvsdkgn lmysdnrsfq gkesifgdnm 961 nelqtfvanr qkdnlnnyvf qgghpltlne snpntvevav steskansrp rqlwkksvds 1021 irqdslsqnp vsqrdeatae nrthslkspr ylpeemahsd isetsnratc hrepdnsknh 1081 ktkdnfkrsv askypkdcse vertylktks ssprdkiyti dgekepgfhl dppqfvenvt 1141 lpenvdfpdp yqdpsenfrk gdstlpmnrn plhneeglsn ndqyklyskh ftlkdkgsph 1201 setseryrqn sthcrsclsn mptysghftm rspfkcdacl rmgnlydide dgmlgetgnp 1261 atgeqvyqqd waqnnalqlq knklrisrqh sydnivdkpr eldlsrpsrs islkdrerll 1321 egnfygslfs vpssklsgkk sslfpqgled skrsksllpd htsdnpflhs hrddqrlvig
```

-continued

```
1381 rcpsdpykhs lpsqavndsy lrsslrstas ycsrdsrghn dvyisehvmp yaanknnmys 1441 tprvlnscsn rrvykkmpsi esdv
```

Glutamate receptor ionotropic, NMDA 2A, isoform 2 precursor
NP_001127880.1

(SEQ ID NO: 268)

```
   1 mgrvgywtll vlpallvwrg papsaaaekg ppalniavml ghshdvtere lrtlwgpeqa 61 aglpldvnvv allmnrtdpk slithvcdlm sgarihglvf gddtdqeava qmldfissht 121 fvpilgihgg asmimadkdp tstffqfgas iqqqatvmlk imgdydwhvf slvttifpgy 181 refisfvktt vdnsfvgwdm qnvitldtsf edaktqvqlk kihssvilly cskdeavlil 241 searslgltg ydffwivpsl vsgntelipk efpsglisys yddwdyslea rvrdgigilt 301 taassmlekf syipeakasc ygqmerpevp mhtlhpfmvn vtwdgkdlsf teegyqvhpr 361 lvvivinkdr ewekvgkwen htlslrhavw pryksfsdce pddnhlsivt leeapfvive 421 didpltetcv rntvperkfv kinnstnegm nvkkcckgfc idilkklsrt vkftydlylv 481 tngkhgkkvn nvwngmigev vyqravmavg sltineerse vvdfsvpfve tgisvmvsrs 541 ngtvspsafl epfsasvwvm mfvmllivsa iavfvfeyfs pvgynrnlak gkaphgpsft 601 igkaiwllwg lvfnnsvpvg npkgttskim vsvwaffavi flasytanla afmigeefvd 661 qvtglsdkkf grphdysppf rfgtvpngst ernirnnypy mhqymtkfnq kgvedalvsl 721 ktgkldafiy daavinykag rdegcklvti gsgyifattg ygialqkgsp wkrqidlall 781 qfvgdgemee letlwltgic hneknevmss qldidnmagv fymlaaamal slitfiwehl 841 fywklrfcft gvcsdrpgll fsisrgiysc ihgvhieekk kspdfnitgs qsnmlkllrs 901 aknissmsnm nssrmdspkr aadfiqrgsl imdmvsdkgn lmysdnrsfq gkesifgdnm 961 nelqtfvanr qkdnlnnyvf qgqhpltlne snpntvevav steskansrp rqlwkksvds 1021 irqdslsqnp vsqrdeatae nrthslkspr ylpeemahsd isetsnratc hrepdnsknh 1081 ktkdnfkrsv askypkdcse vertylktks ssprdkiyti dgekepgfhl dppqfvenvt 1141 lpenvdfpdp yqdpsenfrk gdstlpmnrn plhneeglsn ndqyklyskh ftlkdkgsph 1201 setseryrqn sthcrsclsn mptysghftm rspfkcdacl rmgnlydide dgmlgetgmt 1261 nawllgdapr tltntrchpr r
```

Metabotropic glutamate receptor 3 precursor NP_000831.2

(SEQ ID NO: 269)

```
   1 mkmltrlqvl tlalfskgfl lslgdhnflr reikiegdlv lgglfpinek gtgteecgri 61 nedrgiqrle amlfaidein kddyllpgvk lgvhildtcs rdtyaleqsl efvrasltkv 121 deaeymcpdg syaiqenipl liagviggsy ssysiqvanl lrlfqipgis yastsaklsd 181 ksrydyfart vppdfyqaka maeilrffnw tyvstvaseg dygetgieaf eqearlrnic 241 iataekvgrs nirksydsvi rellqkpnar vvvlfmrsdd sreliaaasr anasftwvas 301 dgwgaqesii kgsehvayga itlelasqpv rqfdryfqsl npynnhrnpw frdfweqkfq 361 cslqnkrnhr rvcdkhlaid ssnyeqeski mfvvnavyam ahalhkmqrt lcpntttklcd 421 amkildgkkl ykdyllkinf tapfnpnkda dsivkfdtfg dgmgrynvfn fqnvggkysy 481 lkvghwaetl sldvnsihws rnsvptsqcs dpcapnemkn mqpgdvccwi cipcepyeyl 541 adeftcmdcg sgqwptadlt gcydlpedyi rwedawaigp vtiaclgfmc tcmvvtvfik 601 hnntplvkas grelcyillf gvglsycmtf ffiakpspvi calrrlglgs sfaicysall 661 tktnciarif dgvkngagrp kfispssqvf iclglilvqi vmvsvwlile apgtrryta 721 ekretvilkc nvkdssmlis ltydvilvil ctvyafktrk cpenfneakf igftmyttci
```

```
781 iwlaflpify vtssdyrvqt ttmcisvsls gfvvlgclfa pkvhiilfqp qknvvthrlh 841 lnrfsvsgtg ttysqssast yvptvcngre vldsttssl
```

HPV E6 concoprotein, NP_041325.1
(SEQ ID NO: 270)
```
  1 mhqkrtamfq dpqerprklp qlctelqtti hdiilecvyc kqqllrrevy dfafrdlciv 61 yrdgnpyavc dkclkfyski seyrhycysl ygttleqqyn kplcdllirc incqkplcpe 121 ekqrhldkkq rfhnirgrwt grcmsccrss rtrretql
```

HPV E7 Oncoprotein, NP_041326.1
(SEQ ID NO: 271)
```
  1 mhgdtptlhe ymldlqpett dlycyeqlnd sseeedeidg pagqaepdra hynivtfcck 61 cdstlrlcvq sthvdirtle dllmgtlgiv cpicsqkp
```

GTPase HRas, isoform 1 NP_001123914.1, NP_005334.1
(SEQ ID NO: 272)
```
  1 mteyklvvvg aggvgksalt iglignhfvd eydptiedsy rkqvvidget clldildtag 61 qeeysamrdq ymrtgegflc vfainntksf edihqyreqi krvkdsddvp mvlvgnkcdl 121 aartvesrqa qdlarsygip yietsaktrq gvedafytiv reirqhklrk lnppdesgpg 181 cmsckcvls
```

GTPase HRas, isoform 3 NP_001304983.1
(SEQ ID NO: 273)
```
  1 mtcpwcwwgt svtwlhalwn lgrlrtspea tasptsrprp rpgraaalal apapgpsgtp 61 rdpcdpaapr agvedafytl vreirqhklr klnppdesgp gcmsckcvls
```

GTPase HRas, isoform 2 NP_789765.1
(SEQ ID NO: 274)
```
  1 mteyklvvvg aggvgksalt iglignhfvd eydptiedsy rkqvvidget clldildtag 61 qeeysamrdq ymrtgegflc vfainntksf edihqyreqi krvkdsddvp mvlvgnkcdl 121 aartvesrqa qdlarsygip yietsaktrq gsrsgsssss gtlwdppgpm
```

Vascular endothelial growth factor receptor 2 precursor NP_002244.1
(SEQ ID NO: 275)
```
   1 mqskvllava lwlcvetraa svglpsysld lprlsiqkdi ltikanttlq itcrgqrdld 61 wlwpnngsgs eqrvevtecs dglfcktlti pkvigndtga ykcfyretdl asviyvyvqd 121 yrspfiasys dqhgvvyite nknktvvipc lgsisnlnvs lcarypekrf vpdgnriswd 181 skkgftipsy misyagmvfc eakindesyq simyivvvvg yriydvvlsp shgielsvge 241 klvlnctart elnvgidfnw eypsskhqhk klvnrdlktq sgsemkkfls tltidgvtrs 301 dqglytcaas sglmtkknst fvrvhekpfv afgsgmeslv eatvgervri pakylgyppp 361 eikwykngip lesnhtikag hvltimevse rdtgnytvil tnpiskekqs hvvslvvyvp 421 pqigekslis pvdsyqygtt qtltctvyai ppphhihwyw qleeecanep sqaysvtnpy 481 pceewrsved fqggnkievn knqfaliegk nktvstiviq aanvsalykc eavnkvgrge 541 rvisfhvtrg peitlqpdmq pteqesyslw ctadrstfen ltwyklgpqp lpihvgelpt 601 pvcknldtlw klnatmfsns tndilimelk naslqdqgdy vclaqdrktk krhcvvrqlt 661 vlervaptit gnlenqttsi gesievscta sgnpppgimw fkdnetived sgivlkdgnr 721 nltirrvrke deglytcqac svlgcakvea ffiiegagek tnleiiilvg taviamffwl 781 llviilrtvk ranggelktg ylsivmdpde lpldehcerl pydaskwefp rdrlklgkpl 841 grgafgqvie adafgidkta tcrtvavkml kegathsehr almselkili highhlnvvn 901 llgactkpgg plmvivefck fgnlstylrs krnefvpykt kgarfrqgkd yvgaipvdlk 961 rrldsitssq ssassgfvee kslsdveeee apedlykdfl tlehlicysf qvakgmefla 1021 srkcihrdla arnillsekn vvkicdfgla rdiykdpdyv rkgdarlplk wmapetifdr
```

-continued

```
1081  vytiqsdvws  fgvllweifs  lgaspypgvk  ideefcrrlk  egtrmrapdy  ttpemyqtml
1141  dcwhgepsqr  ptfselvehl  gnllganagq  dgkdyivlpi  setlsmeeds  glslptspvs
1201  cmeeeevcdp  kfhydntagi  sqylqnskrk  srpvsvktfe  dipleepevk  vipddnqtds
1261  gmvlaseelk  tledrtklsp  sfggmvpsks  resvasegsn  qtsgyqsgyh  sddtdttvys
1321  seeaellkli  eigvqtgsta  qilqpdsgtt  lssppv
```

Mast/stem cell growth acor receptor KIT, isoform 1 precursor
NP_000213.1

(SEQ ID NO: 276)

```
  1  mrgargawdf  lcvllllrv   qtgssqpsys  pgepsppsih  pgksdlivry  gdeirllctd
 61  pgfvkwtfei  ldetnenkqn  ewitekaeat  ntgkytctnk  hglsnsiyvf  vrdpaklflv
121  drslygkedn  dtivrcpltd  pevtnyslkg  cqgkplpkdl  rfipdpkagi  miksvkrayh
181  rlclhcsvdq  egksvlsekf  ilkvrpafka  vpvvsyskas  yllregeeft  vtctikdvss
241  svystwkren  sqtklqekyn  swhhgdfnye  rqatltissa  rvndsgvfmc  yanntfgsan
301  vtttlevvdk  gfinifpmin  ttvfvndgen  vdliveyeaf  pkpehqqwiy  mnrtftdkwe
361  dypksenesn  iryvselhlt  rlkgteggty  tflvsnsdvn  aaiafnvyvn  tkpeiltydr
421  lvngmlqcva  agfpeptidw  yfcpgtegrc  sasvlpvdvq  tlnssgppfg  klvvqssids
481  safkhngtve  ckayndvgkt  sayfnfafkg  nnkeqihpht  lftplligfv  ivagmmciiv
541  miltykylqk  pmyevqwkvv  eeingnnyvy  idptqlpydh  kwefprnrls  fgktlgagaf
601  gkvveatayg  liksdaamtv  avkmlkpsah  lterealmse  lkvlsylgnh  mnivnllgac
661  tiggptivit  eyccygdllln flrrkrdsfi  cskqedhaea  alyknllhsk  esscsdstne
721  ymdmkpgvsy  vvptkadkrr  svrigsyier  dvtpaimedd  elaldledll  sfsyqvakgm
781  aflaskncih  rdlaarnill  thgritkicd  fglardiknd  snyvvkgnar  lpvkwmapes
841  ifncvytfes  dvwsygiflw  elfslgsspy  pgmpvdskfy  kmikegfrml  spehapaemy
901  dimktcwdad  plkrptfkqi  vgliekgise  stnhiysnla  ncspnrqkpv  vdhsvrinsv
961  gstasssqpl  lvhddv
```

Mast/stem cell growth acor receptor KIT, isoform 2 precursor
NP_001087241.1

(SEQ ID NO: 277)

```
  1  mrgargawdf  lcvllllrv   qtgssqpsys  pgepsppsih  pgksdlivry  gdeirllctd
 61  pgfvkwtfei  ldetnenkqn  ewitekaeat  ntgkytctnk  hglsnsiyvf  vrdpaklflv
121  drslygkedn  dtivrcpltd  pevtnyslkg  cqgkplpkdl  rfipdpkagi  miksvkrayh
181  rlclhcsvdq  egksvlsekf  ilkvrpafka  vpvvsyskas  yllregeeft  vtctikdvss
241  svystwkren  sqtklqekyn  swhhgdfnye  rqatltissa  rvndsgvfmc  yanntfgsan
301  vtttlevvdk  gfinifpmin  ttvfvndgen  vdliveyeaf  pkpehqqwiy  mnrtftdkwe
361  dypksenesn  iryvselhlt  rlkgteggty  tflvsnsdvn  aaiafnvyvn  tkpeiltydr
421  lvngmlqcva  agfpeptidw  yfcpgtegrc  sasvlpvdvq  tlnssgppfg  klvvqssids
481  safkhngtve  ckayndvgkt  sayfnfafke  qihphtlftp  lligfvivag  mmviivmilt
541  ykylqkpmye  vqwkvveein  gnnyvyidpt  qlpydhkwef  prnrlsfgkt  lgagafgkvv
601  eatayliks   daamtvavkm  lkpsahlter  ealmselkvl  sylgnhmniv  nllgactigg
661  ptlviteycc  ygdllnflrr  krdsficskq  edhaeaalyk  nllhskessc  sdstneymdm
721  kpgvsyvvpt  kadkrrsvri  gsyierdvtp  aimeddelal  dledllsfsy  qvakgmafla
781  skncihrdla  arnillthgr  itkicdfgla  rdikndsnyv  vkgnarlpvk  wmapesifnc
841  vytfesdvws  ygiflwelfs  lgsspypgmp  vdskfykmik  egfrmlspeh  apaemydimk
```

```
901 tcwdadplkr ptfkqivqli ekqisestnh iysnlancsp nrqkpvvdhs vrinsvgsta 961 sssqpllvhd dv
```

Plasma kallikrein isoform 1 preprotein NP_001639.1
(SEQ ID NO: 278)
```
  1 mwvpvvfltl svtwigaapl ilsrivggwe cekhsqpwqv lvasrgravc ggvlvhpqwv 61 ltaahcirnk svillgrhsl fhpedtgqvf qvshsfphpl ydmsllknrf lrpgddsshd 121 lmllrlsepa eltdavkvmd lptqepalgt tcyasgwgsi epeefltpkk lqcvdlhvis 181 ndvcaqvhpq kvtkfmlcag rwtggkstcs gdsggplvcn gvlqgitswg sepcalperp 241 slytkvvhyr kwikdtivan p
```

Plasma kallikrein isoform 3 preprotein NP_001025218.1
(SEQ ID NO: 279)
```
  1 mwvpvvfltl svtwigaapl ilsrivggwe cekhsqpwqv lvasrgravc ggvlvhpqwv 61 ltaahcirnk svillgrhsl fhpedtgqvf qvshsfphpl ydmsllknrf lrpgddsshd 121 lmllrlsepa eltdavkvmd lptqepalgt tcyasgwgsi epeefltpkk lqcvdlhvis 181 ndvcaqvhpq kvtkfmlcag rwtggkstcs wviliteltm palpmvlhgs lvpwrggv
```

Plasma kallikrein isoform 4 preprotein NP_001025219.1
(SEQ ID NO: 280)
```
  1 mwvpvvfltl svtwigaapl ilsrivggwe cekhsqpwqv lvasrgravc ggvlvhpqwv 61 ltaahcirkp gddsshdlml lrlsepaelt davkvmdlpt qepalgttcy asgwgsiepe 121 efltpkklqc vdlhvisndv caqvhpqkvt kfmlcagrwt ggkstcsgds ggplvcngvl 181 qgitswgsep calperpsly tkvvhyrkwi kdtivanp
```

Tyrosine-protein kinase LCK, isoform a NP_001036236.1, NP_005347.3
(SEQ ID NO: 281)
```
  1 mgcgcsshpe ddwmenidvc enchypivpl dgkgtllirn gsevrdplvt yegsnppasp 61 lqdnlvialh syepshdgdl gfekgeqlri leqsgewwka gslttggegf ipfnfvakan 121 slepepwffk nlsrkdaerq llapgnthgs fliresesta gsfslsvrdf dqnqgevvkh 181 ykirnldngg fyispritfp glhelvrhyt nasdglctrl srpcqtqkpq kpwwedewev 241 pretlklver lgagqfgevw mgyynghtkv avkslkqgsm spdaflaean lmkqlqhqrl 301 vrlyavvtqe piyiiteyme ngslvdflkt psgikltink lldmaagiae gmafieerny 361 ihrdlraani lvsdtlscki adfglarlie dneytarega kfpikwtape ainygtftik 421 sdvwsfgill teivthgrip ypgmtnpevi qnlergyrmv rpdncpeely qlmrlcwker 481 pedrptfdyl rsvledfffta teggyqpqp
```

Tyrosine-protein kinase LCK, isoform b NP_001317397.1
(SEQ ID NO: 282)
```
  1 mgcgcsshpe ddwmenidvc enchypivpl dgkgtllirn gsevrdplvt yegsnppasp 61 lqdnlvialh syepshdgdl gfekgeqlri leqsgewwka qslttggegf ipfnfvakan 121 slepepwffk nlsrkdaerq llapgnthgs fliresesta gsfslsvrdf dqnqgevvkh 181 ykirnldngg fyispritfp glhelvrhyt ryynghtkva vkslkqgsms pdaflaeanl 241 mkqlqhqrlv rlyavvtqep iyiiteymen gslvdflktp sgikltinkl ldmaagiaeg 301 mafieernyi hrdlraanil vsdtlsckia dfglarlied neytaregak fpikwtapea 361 inygtftiks dvwsfgillt eivthgripy pgmtnpeviq nlergyrmvr pdncpeelyq 421 lmrlcwkerp edrptfdylr svledffttat eggyqpqp
```

Legumain preprotein NP_001008530.1, NP_005597.3
(SEQ ID NO: 283)
```
  1 mvwkvavfls valgigavpi ddpedggkhw vvivagsngw ynyrhqadac hayqiihrng 61 ipdeqivvmm yddiaysedn ptpgivinrp ngtdvyqgvp kdytgedvtp qnflavlrgd
```

-continued

```
121 aeavkgigsg kvlksgpqdh vfiyftdhgs tgilvfpned lhvkdlneti hymykhkmyr 181 kmvfyieace sgsmmnhlpd ninvyattaa npressyacy ydekrstylg dwysvnwmed 241 sdvedltket lhkqyhlvks htntshvmqy gnktistmkv mqfqgmkrka sspvplppvt 301 hldltpspdv pltimkrklm ntndleesrq lteeiqrhld arhlieksvr kivsllaase 361 aeveqllser apltghscyp eallhfrthc fnwhsptyey alrhlyvlvn lcekpyplhr 421 iklsmdhvcl ghy
```

Macrophage migration inhibitory factor NP_002406.1
(SEQ ID NO: 284)
```
  1 mpmfivntnv prasvpdgfl seltqqlaqa tgkppgyiav hvvpdqlmaf ggssepcalc 61 slhsigkigg agnrsyskll cgllaerlri spdrvyinyy dmnaanvgwn nstfa
```

MAGE family member A1 NP_004979.3
(SEQ ID NO: 285)
```
  1 msleqrslhc kpeealeagq ealglvcvqa atssssplvl gtleevptag stdppqspqg 61 asafpttinf trqrqpsegs ssreeegpst scileslfra vitkkvadlv gflllkyrar 121 epvtkaemle sviknykhcf peifgkases lqlvfgidvk eadptghsyv lvtclglsyd 181 gllgdnqimp ktgfliivlv miamegghap eeeiweelsv mevydgrehs aygeprkllt 241 qdlvgekyle yrqvpdsdpa ryeflwgpra laetsyvkvl eyvikvsary rfffpslrea 301 alreeeegv
```

Melanoma-associated antigen 10 NP_001011543.2, NP_001238757.1,
NP_066386.2
(SEQ ID NO: 286)
```
  1 mprapkrqrc mpeedlgsgs etqglegaqa plaveedass ststsssfps sfpsssssss 61 sscyplipst peevsaddet pnppqsagia csspsvvasl pldqsdegss sqkeespstl 121 qvlpdseslp rseidekvtd lvqfllfkyq mkepitkaei lesvirnyed hfpllfseas 181 ecmllvfgid vkevdptghs fvlvtslglt ydgmlsdvqs mpktgilili lsiifiegyc 241 tpeeviweal nmmglydgme hliygeprkl ltqdwvqeny leyrqvpgsd paryeflwgp 301 rahaeirkms llkflakvng sdprsfplwy eealkdeeer aqdriattdd ttamasasss 361 atgsfsype
```

Melanoma-associated antigen 12 NP_001159858.1, NP_001159859.1,
NP_005358.2
(SEQ ID NO: 287)
```
  1 mpleqrsqhc kpeegleaqg ealglvgaqa pateegetas ssstivevtl revpaaesps 61 pphspqgast lpttinytlw sqsdegssne eqegpstfpd letsfqvals rkmaelvhfl 121 llkyrarepf tkaemlgsvi rnfqdffpvi fskaseylql vfgievvevv righlyilvt 181 clglsydgll gdnqivpktg lliivlaiia kegdcapeek iweelsvlea sdgredsvfa 241 hprklltqdl vgenyleyrq vpgsdpacye flwgpralve tsyvkvlhhl lkisggphis 301 ypplhewafr egee
```

Melanoma-associated antigen 2 NP_001269430.1, NP_001269431.1,
NP_01269433.1, NP_001269434.1, NP_005352.1, NP_786884.1,
NP_786885.1
(SEQ ID NO: 288)
```
  1 mpleqrsqhc kpeeglearg ealglvgaqa pateeqqtas ssstivevtl gevpaadsps 61 pphspqgass fsttinytlw rqsdegssnq eeegprmfpd lesefqaais rkmvelvhfl 121 llkyrarepv tkaemlesvl rncqdffpvi fskaseylql vfgievvevv pishlyilvt 181 clglsydgll gdnqvmpktg lliivlaiia iegdcapeek iweelsmlev fegredsvfa 241 hprkllmqdl vgenyleyrq vpgsdpacye flwgpralie tsyvkvlhht lkiggephis 301 ypplheralr egee
```

MAGE family member A3 NP_005353.1
(SEQ ID NO: 289)

```
  1 mpleqrsqhc kpeeglearg ealglvgaqa pateeqeaas ssstivevtl gevpaaespd
 61 ppqspqgass lpttmnyplw sqsyedssnq eeegpstfpd lesefqaals rkvaelvhfl
121 llkyrarepv tkaemlgsvv gnwqyffpvi fskassslql vfgielmevd pighlyifat
181 clglsydgll gdnqimpkag lliivlaiia regdcapeek iweelsvlev fegredsilg
241 dpkklltqhf vgenyleyrq vpgsdpacye flwgpralve tsyvkvlhhm vkisggphis
301 ypplhewvlr egee
```

Melanoma-associated antigen 4 NP_001011548.1, NP_001011549.1, NP_001011550.1, NP_002353.3
(SEQ ID NO: 290)

```
  1 msseqksqhc kpeegveaqe ealglvgaqa ptteeqeaav sssplvpgt leevpaaesa
 61 gppgspqgas alpttisftc wrqpnegsss qeeegpstsp daeslfreal snkvdelahf
121 llrkyrakel vtkaemlery iknykrcfpv ifgkaseslk mifgidvkev dpasntytiv
181 tclglsydgl lgnnqifpkt glliivlgti amegdsasee eiweelgvmg vydgrehtvy
241 geprklltqd wvqenyleyr qvpgsnpary eflwgprala etsyvkvleh vvrvnarvri
301 aypslreaal leeeegv
```

Melanoma-associated antigen 6 NP_005354.1, NP_787064.1
(SEQ ID NO: 291)

```
  1 mpleqrsqhc kpeeglearg ealglvgaqa pateeqeaas ssstivevtl gevpaaespd
 61 ppqspqgass lpttmnyplw sqsyedssnq eeegpstfpd lesefqaals rkvaklvhfl
121 llkyrarepv tkaemlgsvv gnwqyffpvi fskasdslql vfgielmevd pighvyifat
181 clglsydgll gdnqimpktg fliiilaiia kegdcapeek iweelsvlev fegredsifg
241 dpkklltqyf vgenyleyrq vpgsdpacye flwgpralie tsyvkvlhhm vkisggpris
301 ypllhewalr egee
```

Melanoma-associated antigen 9 NP_005356.1
(SEQ ID NO: 292)

```
  1 msleqrsphc kpdedleaqg edlglmgage ptgeeeetts ssdskeeevs aagsssppqs
 61 pqggasssis vyytlwsqfd egsssqeeee psssvdpaql efmfgealkl kvaelvhfll
121 hkyrvkepvt kaemlesvik nykryfpvif gkasefmqvi fgtdvkevdp aghsyilvta
181 lglscdsmlg dghsmpkaal liivlgvilt kdncapeevi wealsvmgvy vgkehmfyge
241 prklltqdwv qenyleyrqv pgsdpahyef lwgskahaet syekvinylv mlnarepicy
301 pslyeevlge eqegv
```

Melanoma-associated antigen C2 NP_057333.1
(SEQ ID NO: 293)

```
  1 mppvpgvpfr nvdndsptsv eledwvdaqh ptdeeeeeas sasstlylvf spssfstsss
 61 lilggpeeee vpsgvipnit esipssppqg ppqgpsgspl sscssfsws sfseesssqk
121 gedtgtcqgl pdsessftyt ldekvaelve flllkyeaee pvteaemlmi vikykdyfpv
181 ilkrarefme llfglaliev gpdhfcvfan tvgltdegsd degmpensll iiilsvifik
241 gncaseeviw evlnavgvya grehfvygep relltkvwvq ghyleyrevp hsspyyefl
301 wgprahsesi kkkvleflak lnntvpssfp swykdalkdv eervqatidt addatvmase
361 slsvmssnvs fse
```

Melanoma-associated antigen D1, isoform a NP_001005333.1
(SEQ ID NO: 294)

```
  1 maqkmdcgag llgfqnpdac ravchplpqp pastlplsaf pticdppysq lrdppavlsc
 61 yctplgaspa paeasvedsa llmqtlmeai giseapptnq ataaaspqss qpptanemad
121 iqvsaaaarp ksafkvqnat tkgpngvydf sqahnakdvp ntqpkaafks qnatpkgpna
```

```
181 aydfsqaatt gelaanksem afkagnattk vgpnatynfs qslnandlan srpktpfkaw 241 ndttkaptad tqtqnvnqak matsqadiet dpgisepdga taqtsadgsq aqnlesrtii 301 rgkrtrkinn lnveenssgd qrraplaagt wrsapvpvtt qnppgappnv lwqtplawqn 361 psgwqnqtar qtpparqspp arqtppawqn pvawqnpviw pnpviwqnpv iwpnpivwpg 421 pvvwpnplaw qnppgwqtpp gwqtppgwqg ppdwqgppdw plppdwplpp dwplptdwpl 481 ppdwipadwp ippdwqnlrp spnlrpspns rasqnpgaaq prdvallqer anklvkylml 541 kdytkvpikr semlrdiire ytdvypeiie racfvlekkf giqlkeidke ehlyilistp 601 eslagilgtt kdtpk1glll vilgvifmng nraseavlwe alrkmglrpg vrhpllgdlr 661 klltyefvkq kyldyrrvpn snppeyeflw glrsyhetsk mkvlrfiaev qkrdprdwta 721 qfmeaadeal daldaaaaea earaeartrm gigdeaysgp wswddiefel ltwdeegdfg 781 dpwsripftf waryhgnars rfpqtfagpi igpggtasan faanfgaigf fwve
```

Melanoma-associated antigen D1, isoform b NP_001005332.1, NP_008917.3
(SEQ ID NO: 295)

```
  1 maqkmdcgag llgfqaeasv edsallmqtl meaiqiseap ptnqataaas pqssqpptan 61 emadiqvsaa aarpksafkv qnattkgpng vydfsgahna kdvpntqpka afksqnatpk 121 gpnaaydfsq aattgelaan ksemafkaqn attkvgpnat ynfsgslnan dlansrpktp 181 fkawndttka ptadtqtqnv nqakmatsqa dietdpgise pdgataqtsa dgsgagnles 241 rtiirgkrtr kinnlnveen ssgdqrrapl aagtwrsapv pvttqnppga ppnvlwqtpl 301 awqnpsgwqn qtarqtppar qspparqtpp awqnpvawqn pviwpnpviw qnpviwpnpi 361 vwpgpvvwpn plawqnppgw qtppgwqtpp gwqgppdwqg ppdwplppdw plppdwplpt 421 dwplppdwip adwpippdwq nlrpspnlrp spnsrasqnp gaaqprdval lgeranklvk 481 ylmlkdytkv pikrsemlrd iireytdvyp eiieracfvl ekkfgiqlke idkeehlyil 541 istpeslagi lgttkdtpkl glllvilgvi fmngnrasea vlwealrkmg lrpgvrhpll 601 gdlrklltye fvkqkyldyr rvpnsnppey eflwglrsyh etskmkvlrf iaevqkrdpr 661 dwtaqfmeaa dealdaldaa aaeaearaea rtrmgigdea vsgpwswddi efelltwdee 721 gdfgdpwsri pftfwaryhq narsrfpqtf agpiigpggt asanfaanfg aigffwve
```

Mitogen-activated protein kinase kinase kinase 5 NP_005914.1
(SEQ ID NO: 296)

```
  1 msteadegit fsvppfapsg fctipeggic rrggaaavge geehqlpppp pgsfwnvesa 61 aapgigcpaa tssssatrgr gssvgggsrr ttvayvinea sqgqlvvaes ealqslreac 121 etvgatletl hfgkldfget tvldrfynad iavvemsdaf rqpslfyhlg vresfsmann 181 iilycdtnsd slqslkeiic qkntmctgny tfvpymitph nkvyccdssf mkgltelmqp 241 nfelllgpic lplvdrfiql lkvagasssq yfresilndi rkarnlytgk elaaelarir 301 qrvdnievlt adivinllls yrdigdydsi vklvetlekl ptfdlashhh vkfhyafaln 361 rrnlpgdrak aldimipmvq segqvasdmy clvgriykdm fldsnftdte srdhgaswfk 421 kafeseptlq sginyavlll aaghqfessf elrkvgvkls sllgkkgnle klqsywevgf 481 flgasvland hmrviqasek lfklktpawy lksivetili ykhfvkltte qpvakqelvd 541 fwmdflveat ktdvtvvrfp vlileptkiy gpsylsinne veektisiwh vlpddkkgih 601 ewnfsassvr gvsiskfeer ccflyvlhns ddfqiyfcte lhckkffemv ntiteekgrs 661 teegdcesdl leydyeyden gdrvvlgkgt ygivyagrdl snqvriaike iperdsrysq 721 plheeialhk hlkhknivqy lgsfsengfi kifmeqvpgg slsallrskw gplkdneqti 781 gfytkqileg lkylhdnqiv hrdikgdnvl intysgvlki sdfgtskrla ginpctetft
```

-continued

```
 841 gtlqymapei idkgprgygk aadiwslgct iiematgkpp fyelgepqaa mfkvgmfkvh 901 peipesmsae akafilkcfe pdpdkracan dllvdeflkv sskkkktqpk lsalsagsne 961 ylrsislpvp vlvedtssss eygsyspdte lkvdpfsfkt rakscgerdv kgirtlflgi 1021 pdenfedhsa ppspeekdsg ffmlrkdser ratlhrilte dqdkivrnlm eslaggaeep 1081 klkwehittl iaslrefvrs tdrkiiattl sklkleldfd shgisqvqvv lfgfqdavnk 1141 vlrnhnikph wmfaldsiir kavqtaitil vpelrphfsl asesdtadqe dldveddhee 1201 qpsnqtvrrp qaviedavat sgvstlsstv shdsqsahrs lnvqlgrmki etnrlleelv 1261 rkekelqall hraieekdqe ikhlklksqp ieipelpvfh lnssgtnted seltdwlrvn 1321 gadedtisrf laedytlldv lyyvtrddlk clrlrggmlc tlwkaiidfr nkqt
```

Mitogen-activated protein kinase kinase kinase 9, isoform 1
NP_149132.2

(SEQ ID NO: 297)

```
   1 mepsrallgc lasaaaaapp gedgagagae eeeeeeeeaa aavgpgelgc daplpywtav 61 feyeaagede ltlrlgdvve vlskdsqvsg degwwtgqln qrvgifpsny vtprsafssr 121 cqpggedpsc yppiqlleid faeltleeii giggfgkvyr afwigdevav kaarhdpded 181 isqtienvrq eaklfamlkh pniialrgvc lkepnlclvm efarggpinr vlsgkrippd 241 ilvnwavqia rgmnylhdea ivpiihrdlk ssnililqkv engdlsnkil kitdfglare 301 whrttkmsaa gtyawmapev irasmfskgs dvwsygvllw elltgevpfr gidglavayg 361 vamnklalpi pstcpepfak lmedcwnpdp hsrpsftnil dqlttieesg ffempkdsfh 421 clqdnwkhei qemfdqlrak ekelrtweee ltraalqqkn geellrrreq elaereidil 481 erelniiihq lcqekprvkk rkgkfrksrl klkdgnrisl psdfqhkftv qasptmdkrk 541 slinsrsspp asptiiprlr aiqltpgess ktwgrssvvp keegeeeekr apkkkgrtwg 601 pgtlgqkela sgdegspqrr ekanglstps esphfhlglk slvdgykqws ssapnlvkgp 661 rsspalpgft slmemallaa swvvpidiee dedsegpgsg esrlqhspsq sylcipfprg 721 edgdgpssdg iheeptpvns atstpqltpt nslkrggahh rrcevallgc gavlaatglg 781 fdlleagkcq llpleepepp areekkrreg lfqrssrprr stsppsrklf kkeepmlllg 841 dpsasltlls lssisecnst rsllrsdsde ivvyempvsp veapplspct hnplvnvrve 901 rfkrdpnqsl tpthvtlttp sqpsshrrtp sdgalkpetl lasrspssng lspspgagml 961 ktpspsrdpg efprlpdpnv vfpptprrwn tqqdstlerp ktleflprpr psanrqrldp 1021 wwfvspshar stspanssst etpsnldscf asssstveer pglpallpfq agplppptert 1081 lldldaeggqs qdstvplcra elnthrpapy eiqqefws
```

Mitogen-activated protein kinase kinase kinase 9, isoform 2
NP_001271159.1

(SEQ ID NO: 298)

```
   1 mepsrallgc lasaaaaapp gedgagagae eeeeeeeeaa aavgpgelgc daplpywtav 61 feyeaagede ltlrlgdvve vlskdsqvsg degwwtgqln qrvgifpsny vtprsafssr 121 cqpggedpsc yppiqlleid faeltleeii giggfgkvyr afwigdevav kaarhdpded 181 isqtienvrq eaklfamlkh pniialrgvc lkepnlclvm efarggpinr vlsgkrippd 241 ilvnwavqia rgmnylhdea ivpiihrdlk ssnililqkv engdlsnkil kitdfglare 301 whrttkmsaa gtyawmapev irasmfskgs dvwsygvllw elltgevpfr gidglavayg 361 vamnklalpi pstcpepfak lmedcwnpdp hsrpsftnil dqlttieesg ffempkdsfh 421 clqdnwkhei qemfdqlrak ekelrtweee ltraalqqkn geellrrreq elaereidil 481 erelniiihq lcqekprvkk rkgkfrksrl klkdgnrisl psdfqhkftv qasptmdkrk 541 slinsrsspp asptiiprlr aiqltpgess ktwgrssvvp keegeeeekr apkkkgrtwg
```

-continued

```
 601 pgtlgqkela sgdegspqrr ekanglstps esphfhlglk slvdgykqws ssapnlvkgp 661 rsspalpgft slmemededs egpgsgesrl ghspsgsylc ipfprgedgd gpssdgihee 721 ptpvnsatst pqltptnslk rggahhrrce vallgcgavl aatglgfdll eagkcqllpl 781 eepepparee kkrreglfqr ssrprrstsp psrklfkkee pmlllgdpsa sltllslssi 841 secnstrsll rsdsdeivvy empvspveap plspcthnpl vnvrverfkr dpnqsltpth 901 vtlttpsqps shrrtpsdga lkpetllasr spssnglsps pgagmlktps psrdpgefpr 961 lpdpnvvfpp tprrwntqqd stlerpktle flprprpsan rqrldpwwfv spsharstsp 1021 anssstetps nldscfasss stveerpglp allpfgagpl pptertlldl daeggsgdst 1081 vplcraelnt hrpapyeiqq efws
```

Mitogen-activated protein kinase kinase kinase 9, isoform 3
NP_001271160.1

(SEQ ID NO: 299)

```
   1 meltgleval vlilqkveng dlsnkilkit dfglarewhr ttkmsaagty awmapevira 61 smfskgsdvw sygvllwell tgevpfrgid glavaygvam nklalpipst cpepfaklme 121 dcwnpdphsr psftnildql ttieesgffe mpkdsfhclq dnwkheiqem fdqlrakeke 181 lrtweeeltr aalqqknqee llrrregela ereidilere lniiihqlcq ekprvkkrkg 241 kfrksrlklk dgnrislpsd fqhkftvgas ptmdkrksli nsrssppasp tiiprlraiq 301 cetvsqiswg qntqghlspa lsshrlvqac sihnfchlss tmciymhilt pgessktwgr 361 ssvvpkeege eeekrapkkk grtwgpgtlg qkelasgdeg lkslvdgykq wsssapnlvk 421 gprsspalpg ftslmemall aaswvvpidi eededsegpg sgesrlqhsp sqsylcipfp 481 rgedgdpss dgiheeptpv nsatstpqlt ptnslkrgga hhrrcevall gcgavlaatg 541 lgfdlleagk cqllpleepe ppareekkrr eglfqrssrp rrstsppsrk lfkkeepmll 601 lgdpsasltl lslssisecn strsllrsds deivvyempv spveapplsp cthnplvnvr 661 verfkrdpnq sltpthvtlt tpsqpsshrr tpsdgalkpe tllasrspss nglspspgag 721 mlktpspsrd pgefprlpdp nvvfpptprr wntqqdstle rpktleflpr prpsanrqrl 781 dpwwfvspsh arstspanss stetpsnlds cfassssstve erpglpallp fqagplppte 841 rtllldldaeg qsdstvplc raelnthrpa pyeiqqefws
```

Mitogen-activated protein kinase kinase kinase 9, isoform 4
NP_001271161.1

(SEQ ID NO: 300)

```
   1 msaagtyawm apevirasmf skgsdvwsyg vllwelltge vpfrgidgla vaygvamnkl 61 alpipstcpe pfaklmedcw npdphsrpsf tnildqltti eesgffempk dsfhclqdnw 121 kheiqemfdq lrakekelrt weeeltraal qqknqeellr rreqelaere idilerelni 181 iihqlcqekp rvkkrkgkfr ksrlklkdgn rislpsdfqh kftvgasptm dkrkslinsr 241 ssppasptii prlraiqcet vsgiswgqnt qghlspalss hrlvqacsih nfchlsstmc 301 iymhiltpge ssktwgrssv vpkeegeeee krapkkkgrt wgpgtlggke lasgdeglks 361 lvdgykqwss sapnlvkgpr sspalpgfts lmemallaas wvvpidieed edsegpgsge 421 srlqhspsqs ylcipfprge dgdpssdgi heeptpvnsa tstpqltptn slkrggahhr 481 rcevallgcg avlaatglgf dlleagkcql lpleepeppa reekkrregl fqrssrprrs 541 tsppsrklfk keepmlllgd psasltllsl ssisecnstr sllrsdsdei vvyempvspv 601 eapplspcth nplvnvrver fkrdpnqslt pthvtlttps qpsshrrtps dgalkpetll 661 asrspssngl spspgagmlk tpspsrdpge fprlpdpnvv fpptprrwnt qqdstlerpk
```

-continued

```
721 tleflprprp sanrqrldpw wfvspshars tspanssste tpsnldscfa sssstveerp 781 glpallpfqa gplppterti ldldaeggsq dstvplcrae lnthrpapye iqqefws
```

Mitogen-activated protin kinase 1 NP_002736.3, NP_620407.1
(SEQ ID NO: 301)

```
  1 maaaaaagag pemvrgqvfd vgprytnlsy igegaygmvc saydnvnkvr vaikkispfe 61 hqtycqrtlr eikillrfrh eniigindii raptieqmkd vyivqdlmet dlykllktqh 121 lsndhicyfl yqilrglkyi hsanvlhrdl kpsnllintt cdlkicdfgl arvadpdhdh 181 tgflteyvat rwyrapeiml nskgytksid iwsvgcilae mlsnrpifpg khyldqlnhi 241 lgilgspsqe dlnciinlka rnyllslphk nkvpwnrlfp nadskaldll dkmltfnphk 301 rieveqalah pyleqyydps depiaeapfk fdmelddlpk eklkelifee tarfqpgyrs
```

Melan-A NP_005502.1
(SEQ ID NO: 302)

```
  1 mpredahfiy gypkkghghs yttaeeaagi giltvilgvl lligcwycrr rngyralmdk 61 slhvgtqcal trrcpqegfd hrdskvslqe kncepvvpna ppayeklsae qspppysp
```

Melanotransferrin, isoform 1 preprotein NP_005920.2
(SEQ ID NO: 303)

```
  1 mrgpsgalwl llalrtvlgg mevrwcatsd peqhkcgnms eafreagiqp sllcvrgtsa 61 dhcvqliaaq eadaitldgg aiyeagkehg lkpvvgevyd qevgtsyyav avvrrsshvt 121 idtlkgvksc htginrtvgw nvpvgylves grlsvmgcdv lkaysdyfgg scvpgagets 181 yseslcrlcr gdssgegvcd kspleryydy sgafrclaeg agdvafvkhs tvlentdgkt 241 lpswgqalls qdfellcrdg sradvtewrq chlarvpaha vvvradtdgg lifrllnegq 301 rlfshegssf qmfsseaygq kdllfkdsts elvpiatqty eawlgheylh amkgllcdpn 361 rlppylrwcv lstpeiqkcg dmavafrrqr lkpeiqcvsa kspqhcmeri qaeqvdavtl 421 sgediytagk tyglvpaage hyapedssns yyvvavvrrd sshaftldel rgkrschagf 481 gspagwdvpv galiqrgfir pkdcdvltav seffnascvp vnnpknypss lcalcvgdeq 541 grnkcvgnsq eryygyrgaf rclvenagdv afvrhttvfd ntnghnsepw aaelrsedye 601 llcpngarae vsqfaacnla qipphavmvr pdtniftvyg lldkaqdlfg ddhnkngfkm 661 fdssnyhgqd llfkdatvra vpvgekttyr gwlgldyvaa legmssqqcs gaaapapgap 721 llplllpala arllppal
```

Melanotransferrin, isoform 2 precursor NP_201573.1
(SEQ ID NO: 304)

```
  1 mrgpsgalwl llalrtvlgg mevrwcatsd peqhkcgnms eafreagiqp sllcvrgtsa 61 dhcvqliaaq eadaitldgg aiyeagkehg lkpvvgevyd qevgtsyyav avvrrsshvt 121 idtlkgvksc htginrtvgw nvpvgylves grlsvmgcdv lkaysdyfgg scvpgagets 181 yseslcrlcr gdssgegvcd kspleryydy sgafrclaeg agdvafvkhs tvlentdesp 241 srrqtwtrse eeegecpahe earrtmrssa gqawkwapvh rpqdesdkge fgkraksrdm 301 lg
```

Baculoviral IAP repeat containing 7, isoform alpha NP_647478.1
(SEQ ID NO: 305)

```
  1 mgpkdsakcl hrgpqpshwa agdgptqerc gprslgspvl gldtcrawdh vdgqilgqlr 61 plteeeeeeg agatlsrgpa fpgmgseelr lasfydwplt aevppellaa agffhtghqd 121 kvrcffcygg lqswkrgddp wtehakwfps cqfllrskgr dfvhsvgeth sqllgswdpw 181 eepedaapva psvpasgype lptprrevqs esagepggvs paeagrawwv leppgardve 241 aqlrrlqeer tckvcldrav sivfvpcghl vcaecapglq lcpicrapvr srvrtfls
```

Baculoviral IAP repeat containing 7, isoform beta NP_071444.1
(SEQ ID NO: 306)
```
  1 mgpkdsakcl hrgpqpshwa agdgptqerc gprslgspvl gldtcrawdh vdgqilgqlr
 61 plteeeeeeg agatlsrgpa fpgmgseelr lasfydwplt aevppellaa agffhtghqd
121 kvrcffcygg lqswkrgddp wtehakwfps cqfllrskgr dfvhsvgeth sqllgswdpw
181 eepedaapva psvpasgype lptprrevqs esaqepgard veaglrrlge ertckvcldr
241 aysivfvpcg hlvcaecapg lqlcpicrap vrsrvrtfls
```

Neutrophil collagenase, isoform 1 preprotein NP_002415.1
(SEQ ID NO: 307)
```
  1 mfslktlpfl lllhvqiska fpvsskeknt ktvqdylekf yqlpsnqyqs trkngtnviv
 61 eklkemqrff glnvtgkpne etldmmkkpr cgvpdsggfm ltpgnpkwer tnityrirny
121 tpqlseaeve raikdafelw svaspliftr isqgeadini afyqrdhgdn spfdgpngil
181 ahafqpgqgi ggdahfdaee twtntsanyn lflvaahefg hslglahssd pgalmypnya
241 fretsnyslp qddidgiqai yglssnpiqp tgpstpkpcd psltfdaitt lrgeilffkd
301 ryfwrrhpql qrvemnfisl fwpslptgiq aayedfdrdl iflfkgnqyw alsgydilqg
361 ypkdisnygf pssvqaidaa vfyrsktyff vndqfwrydn qrqfmepgyp ksisgafpgi
421 eskvdavfqq ehffhvfsgp ryyafdliaq rvtrvargnk wlncryg
```

Neutrophil collagenase, isoform 2 NP_001291370.1, NP_001291371.1
(SEQ ID NO: 308)
```
  1 mqqipgeksi ndylekfyql psnqyqstrk ngtnvivekl kemqrffgln vtgkpneetl
 61 dmmkkprcgv pdsggfmltp gnpkwertnl tyrirnytpq lseaeverai kdafelwsva
121 spliftrisq geadiniafy qrdhgdnspf dgpngilaha fqpgqgiggd ahfdaeetwt
181 ntsanynlfl vaahefghsl glahssdpga lmypnyafre tsnyslpqdd idgigaiygl
241 ssnpiqptgp stpkpcdpsl tfdaittlrg eilffkdryf wrrhpqlqry emnfislfwp
301 slptgiqaay edfdrdlifl fkgnqywals gydilqgypk disnygfpss vqaidaavfy
361 rsktyffvnd qfwrydnqrq fmepgypksi sgafpgiesk vdavfqqehf fhvfsgpryy
421 afdliaqrvt rvargnkwln cryg
```

Mesothelin, isoform 1 preprotein NP_001170826.1, NP_005814.2
(SEQ ID NO: 309)
```
  1 malptarpll gscgtpalgs llfllfslgw vqpsrtlage tgqeaapldg vlanppniss
 61 lsprqllgfp caevsglste rvrelavala qknvklsteq lrclahrlse ppedldalpl
121 dlllflnpda fsgpqactrf fsritkanvd llprgaperq rllpaalacw gvrgsllsea
181 dvralgglac dlpgrfvaes aevllprlvs cpgpldqdqq eaaraalqgg gppygppstw
241 systmdalrg llpvlgqpii rsipqgivaa wrqrssrdps wrqpertilr prfrrevekt
301 acpsgkkare ideslifykk weleacvdaa llatqmdrvn aipftyeqld vlkhkldely
361 pggypesviq hlgylflkms pedirkwnvt sletlkalle vnkghemspq vatlidrfvk
421 grgqldkdtl dtltafypgy lcslspeels svppssiwav rpqdldtcdp rqldvlypka
481 rlafqnmngs eyfvkigsfl ggaptedlka lsqqnvsmdl atfmklrtda vlpltvaevq
541 kllgphvegl kaeerhrpvr dwilrqrqdd ldtlglglqg gipngylvld lsmgealsgt
601 pcllgpgpvl tvlalllast la
```

Mesothelin, isoform 2 preprotein NP_037536.2
(SEQ ID NO: 310)
```
  1 malptarpll gscgtpalgs llfllfslgw vqpsrtlage tgqeaapldg vlanppniss
 61 lsprqllgfp caevsglste rvrelavala qknvklsteq lrclahrlse ppedldalpl
121 dlllflnpda fsgpqactrf fsritkanvd llprgaperq rllpaalacw gvrgsllsea
```

-continued

```
181 dvralgglac dlpgrfvaes aevllprlvs cpgpldqdqq eaaraalqgg gppygppstw 241 systmdalrg llpvlgqpii rsipqgivaa wrqrssrdps wrqpertilr prfrrevekt 301 acpsgkkare ideslifykk weleacvdaa llatqmdrvn aipftyeqld vlkhkldely 361 pggypesviq hlgylflkms pedirkwnvt sletlkalle vnkghemspq aprrplpqva 421 tlidrfvkgr gqldkdtldt ltafypgylc slspeelssv ppssiwavrp qdldtcdprq 481 ldvlypkarl afqnmngsey fvkiqsflgg aptedlkals qqnvsmdlat fmklrtdavl 541 pltvaevqkl lgphveglka eerhrpvrdw ilrqrqddld tlglglqggi pngylvldls 601 mqealsgtpc llgpgpvltv lalllastla
```

Mucin-1, isoform 1 precursor NP_002447.4
(SEQ ID NO: 311)
```
  1 mtpgtqspff llllltvltv vtgsghasst pggeketsat qrssvpsste knalstgvsf 61 fflsfhisnl qfnssledps tdyygelgrd isemflqiyk qggflglsni kfrpgsvvvq 121 ltlafregti nvhdvetqfn qykteaasry nitisdvsys dvpfpfsaqs gagvpgwgia 181 llvlvcvlva laivyliala vcgcrrknyg qldifpardt yhpmseypty hthgryvpps 241 stdrspyekv sagnggssls ytnpavaats anl
```

Mucin-1, isoform 2 precursor NP_001018016.1
(SEQ ID NO: 312)
```
  1 mtpgtqspff llllltvlta ttapkpatvv tgsghasstp ggeketsatq rssvpsstek 61 nafnssledp stdyygelqr disemflqiy kqggflglsn ikfrpgsvvv qltlafregt 121 invhdvetqf nqykteaasr ynitisdvsv sdvpfpfsaq sgagvpgwgi allvlvcvlv 181 alaivylial avcgcrrkny gqldifpard tyhpmseypt yhthgryvpp sstdrspyek 241 vsagnggssl sytnpavaat sanl
```

Mucin-1, isoform 3 precursor NP_001018017.1
(SEQ ID NO: 313)
```
  1 mtpgtqspff llllltvltv vtgsghasst pggeketsat qrssvpsste knafnssled 61 pstdyyqelq rdisemflqi ykqggflgls nikfrpgsvv vqltlafreg tinvhdvetq 121 fnqykteaas rynitisdvs vsdvpfpfsa qsgagvpgwg iallvlvcvl valaivylia 181 lavcqcrrkn yggldifpar dtyhpmseyp tyhthgryvp psstdrspye kvsagnggss 241 lsytnpavaa tsanl
```

Mucin-1, isoform 5 precursor NP_001037855.1
(SEQ ID NO: 314)
```
  1 mtpgtqspff llllltvltv vtgsghasst pggeketsat qrssvpsste knaipapttt 61 kscretflkc fcrfinkgvf waspilssys dvpfpfsaqs gagvpgwgia llvlvcvlva 121 laivyliala vcgcrrknyg qldifpardt yhpmseypty hthgryvpps stdrspyekv 181 sagnggssls ytnpavaats anl
```

Mucin-1, isoform 6 precursor NP_001037856.1
(SEQ ID NO: 315)
```
  1 mtpgtqspff llllltvltv vtgsghasst pggeketsat qrssvpsste knafnssled 61 pstdyyqelq rdisemavcq crrknyggld ifpardtyhp mseyptyhth gryvppsstd 121 rspyekvsag nggsslsytn pavaatsanl
```

Mucin-1, isoform 7 precursor NP_001037857.1
(SEQ ID NO: 316)
```
  1 mtpgtqspff llllltvlta ttapkpatvv tgsghasstp ggeketsatq rssvpsstek 61 nafnssledp stdyygelqr disemavcqc rrknyggldi fpardtyhpm seyptyhthg 121 ryvppsstdr spyekvsagn ggsslsytnp avaatsanl
```

Mucin-1, isoform 8 precursor NP_001037858.1
(SEQ ID NO: 317)
```
  1 mtpgtqspff llllltvltv vtgsghasst pggeketsat qrssvpsste knaipapttt
```

-continued

```
 61 kscretflkc fcrfinkgvf waspilssvw gwgarlghra agaglcsgca ghclshclgc 121 lsvppkelra aghlsspgyl psyervphlp hpwalcap
```

Mucin-1, isoform 9 precursor NP_001191214.1
(SEQ ID NO: 318)

```
  1 mtpgtqspff llllltvltv vtgsghasst pggeketsat qrssvpsste knaysmtssv 61 lsshspgsgs sttqgqdvtl apatepasgs aatwgqdvts vpvtrpalgs ttppandvts 121 apdnkpapgs tappahgvts apdtrpapgs tappahgvts apdnrpalgs tappvhnvts 181 asgsasgsas tivhngtsar atttpaskst pfsipshhsd tpttlashst ktdassthhs 241 tvppltssnh stspqlstgv sffflsfhis nlqfnssled pstdyyqelq rdisemflqi 301 ykqggflgls nikfrpgsvv vqltlafreg tinvhdvetq fnqykteaas rynitisdvs 361 vsdvpfpfsa qsgagvpgwg iallvlvcvl valaivylia lavcqcrrkn yggldifpar 421 dtyhpmseyp tyhthgryvp psstdrspye kvsagnggss lsytnpavaa tsanl
```

Mucin-1, isoform 10 precursor NP_001191215.1
(SEQ ID NO: 319)

```
  1 mtpgtqspff llllltvlta ttapkpatvv tgsghasstp ggeketsatq rssvpsstek 61 naysmtssvl sshspgsgss ttqgqdvtla patepasgsa atwgqdvtsv pvtrpalgst 121 tppandvtsa pdnkpapgst appahgvtsa pdtrpapgst appahgvtsa pdnrpalgst 181 appvhnvtsa sgsasgsast lvhngtsara tttpaskstp fsipshhsdt pttlashstk 241 tdassthhst vppltssnhs tspqlstgvs ffflsfhisn lqfnssledp stdyygelqr 301 disemflqiy kqggflglsn ikfrpgsvvv qltlafregt invhdvetqf nqykteaasr 361 ynitisdvsv sdvpfpfsaq sgagvpgwgi allvlvcvlv alaivylial avcgcrrkny 421 gqldifpard tyhpmseypt yhthgryvpp sstdrspyek vsagnggssl sytnpavaat 481 sanl
```

Mucin-1, isoform 11 precursor NP_001191216.1
(SEQ ID NO: 320)

```
  1 mtpgtqspff llllltvlta ttapkpatvv tgsghasstp ggeketsatq rssvpsstek 61 nalstgvsff flsfhisnlq fnssledpst dyygelgrdi semflqiykq ggflglsnik 121 frpgsvvvql tlafregtin vhdvetqfnq ykteaasryn ltisdvsysd vpfpfsaqsg 181 agvpgwgial lvlvcvlval aivylialav cgcrrknygq ldifpardty hpmseyptyh 241 thgryvppss tdrspyekvs agnggsslsy tnpavaatsa nl
```

Mucin-1, isoform 12 precursor NP_001191217.1
(SEQ ID NO: 321)

```
  1 mtpgtqspff llllltvlta ttapkpatvv tgsghasstp ggeketsatq rssvpsstek 61 nafnssledp stdyygelqr disemflqiy kqggflglsn ikfrpgsvvv qltlafregt 121 invhdvetqf nqykteaasr ynitisdvsv wgwgarlghr aagaglcsgc aghclshclg 181 clsvppkelr aaghlsspgy lpsyervphl phpwalcap
```

Mucin-1, isoform 13 precursor NP_001191218.1
(SEQ ID NO: 322)

```
  1 mtpgtqspff llllltvlta ttapkpatvv tgsghasstp ggeketsatq rssvpsstek 61 naiykqggfl glsnikfrpg svvvqltlaf regtinvhdv etqfnqykte aasrynitis 121 dvsysdvpfp fsaqsgagvp gwgiallvlv cvlvalaivy lialavcqcr rknyggldif 181 pardtyhpms eyptyhthgr yvppsstdrs pyekvsagng gsslsytnpa vaatsanl
```

Mucin-1, isoform 14 precursor NP_001191219.1
(SEQ ID NO: 323)

```
  1 mtpgtqspff llllltvltg geketsatqr ssvpsstekn aiykqggflg lsnikfrpgs 61 vvvqltlafr egtinvhdve tqfnqyktea asrynitisd vsysdvpfpf saqsgagvpg
```

```
121 wgiallvlvc vlvalaivyl ialavcqcrr knyggldifp ardtyhpmse yptyhthgry 181 vppsstdrsp yekvsagngg sslsytnpav aatsanl
```

Mucin-1, isoform 15 precursor NP_001191220.1
(SEQ ID NO: 324)
```
  1 mtpgtqspff lllltvlta ttapkpatvv tgsghasstp ggeketsatq rssvpsstek 61 naflqiykqg gflglsnikf rpgsvvvqlt lafregtinv hdvetqfnqy kteaasrynl 121 tisdvsysdv pfpfsaqsga gvpgwgiall vlvcvlvala ivylialavc gcrrknygql 181 difpardtyh pmseyptyht hgryvppsst drspyekvsa gnggsslsyt npavaatsan 241 l
```

Mucin-1, isoform 16 precursor NP_001191221.1
(SEQ ID NO: 325)
```
  1 mtpgtqspff lllltvlta ttapkpatvv tgsghasstp ggeketsatq rssvpsstek 61 naipaptttk scretflkwp gsvvvqltla fregtinvhd vetqfnqykt eaasryniti 121 sdvsysdvpf pfsaqsgagv pgwgiallvl vcvlvalaiv ylialavcqc rrknyggldi 181 fpardtyhpm seyptyhthg ryvppsstdr spyekvsagn ggsslsytnp avaatsanl
```

Mucin-1, isoform 17 precursor NP_001191222.1
(SEQ ID NO: 326)
```
  1 mtpgtqspff lllltvltv vtgsghasst pggeketsat qrssvpsste knalstgvsf 61 fflsfhisnl qfnssledps tdyygelgrd isemflqiyk qggflglsni kfrpgsvvvq 121 ltlafregti nvhdvetqfn qykteaasry nitisdvsgc lsvppkelra aghlsspgyl 181 psyervphlp hpwalcap
```

Mucin-1, isoform 18 precursor NP_001191223.1
(SEQ ID NO: 327)
```
  1 mtpgtqspff lllltvltv vtgsghasst pggeketsat qrssvpsste knaipapttt 61 kscretflkw pgsvvvqltl afregtinvh dvetqfnqyk teaasrynit isdvsysdvp 121 fpfsaqsgag vpgwgiallv lvcvlvalai vylialavcq crrknyggld ifpardtyhp 181 mseyptyhth gryvppsstd rspyekvsag nggsslsytn pavaatsanl
```

Mucin-1, isoform 19 precursor NP_001191224.1
(SEQ ID NO: 328)
```
  1 mtpgtqspff lllltvlta ttapkpatvv tgsghasstp ggeketsatq rssvpsstek 61 nafnssledp stdyygelqr disemsgagv pgwgiallvl vcvlvalaiv ylialavcqc 121 rrknyggldi fpardtyhpm seyptyhthg ryvppsstdr spyekvsagn ggsslsytnp 181 avaatsanl
```

Mucin-1, isoform 20 precursor NP_001191225.1
(SEQ ID NO: 329)
```
  1 mtpgtqspff lllltvlta ttapkpatvv tgsghasstp ggeketsatq rssvpsstek 61 naipaptttk scretflkcf crfinkgvfw aspilssysd vpfpfsaqsg agvpgwgial 121 lvlvcvlval aivylialav cgcrrknygq ldifpardty hpmseyptyh thgryvppss 181 tdrspyekvs agngssslsy tnpavaatsa nl
```

Mucin-1, isoform 21 precursor NP_001191226.1
(SEQ ID NO: 330)
```
  1 mtpgtqspff lllltvlta ttapkpatvv tgsghasstp ggeketsatq rssvpsstek 61 nalstgvsff flsfhisnlq fnssledpst dyygelgrdi semavcqcrr knyggldifp 121 ardtyhpmse yptyhthgry vppsstdrsp yekvsagngg sslsytnpav aatsanl
```

N-myc proto-oncogene protein, isoform 1 NP_001280157.1, NP_005369.2
(SEQ ID NO: 331)
```
  1 mpscststmp gmicknpdle fdslqpcfyp deddfyfggp dstppgediw kkfellptpp 61 lspsrgfaeh sseppswvte mllenelwgs paeedafglg glggltpnpv ilqdcmwsgf 121 sareklerav seklqhgrgp ptagstaqsp gagaaspagr ghggaagagr agaalpaela
```

```
181 hpaaecvdpa vvfpfpvnkr epapvpaapa sapaagpava sgagiaapag apgvapprpg 241 grqtsggdhk alstsgedtl sdsddeddee edeeeeidvv tvekrrsssn tkavttftit 301 vrpknaalgp graqsselil krclpihqqh nyaapspyve sedappqkki kseasprplk 361 svippkaksl sprnsdseds errrnhnile rqrrndlrss fltlrdhvpe lvknekaakv 421 vilkkateyv hslqaeehql llekeklqar qqqllkkieh artc
```

N-myc proto-oncogene protein, isoform 2 NP_001280160.1
(SEQ ID NO: 332)
```
  1 mrgapgncvg aeqalarrkr aqtvairghp rppgppgdtr aesppdplqs agddeddeee 61 deeeeidvvt vekrrsssnt kavttftitv rpknaalgpg raqsselilk rclpihqqhn 121 yaapspyves edappqkkik seasprplks vippkaksls prnsdsedse rrrnhniler 181 qrrndlrssf ltlrdhvpel vknekaakvv ilkkateyvh slqaeehqll lekeklgarq 241 qqllkkieha rtc
```

N-myc proto-oncogene protein, isoform 3 NP_001280162.1
(SEQ ID NO: 333)
```
  1 mrgapgncvg aeqalarrkr aqtvairghp rppgppgdtr aesppdplqs agvlevgagp 61 rlprppregs tpgiktngae rspqspagrr adaellhvhh aghdlqeprp rv
```

Cancer/testis antigen 1B NP_001318.1
(SEQ ID NO: 334)
```
  1 mqaegrgtgg stgdadgpgg pgipdgpggn aggpgeagat ggrgprgaga arasgpggga 61 prgphggaas glngccrcga rgpesrllef ylampfatpm eaelarrsla qdapplpvpg 121 vllkeftvsg niltirltaa dhrqlqlsis sclqqlsllm witqcflpvf laqppsgqrr
```

Opioid growth factor receptor NP_031372.2
(SEQ ID NO: 335)
```
  1 mddpdcdstw eedeedaeda ededcedgea agardadagd edeeseepra arpssfqsrm 61 tgsrnwratr dmcryrhnyp dlverdcngd tpnlsfyrne irflpngcfi edilqnwtdn 121 ydllednhsy iqwlfplrep gvnwhakplt lrevevfkss geigerlvra yelmlgfygi 181 rledrgtgtv gragnyqkrf qnlnwrshnn lritrilksl gelglehfqa plvrffleet 241 lvrrelpgvr qsaldyfmfa vrcrhqrrql vhfawehfrp rckfvwgpqd klrrfkpssl 301 phplegsrkv eeegspgdpd heastqgrtc gpehskgggr vdegpqprsv epqdagpler 361 sqgdeagghg edrpeplspk eskkrklels rreqpptepg pqsaseveki alnlegcals 421 ggslrtgtge vggqdpgeav qperqplgar vadkvrkrrk vdegagdsaa vasggaqtla 481 lagspapsgh pkaghsengv eedtegrtgp kegtpgspse tpgpspagpa gdepaespse 541 tpgprpagpa gdepaespse tpgprpagpa gdepaespse tpgpspagpt rdepaespse 601 tpgprpagpa gdepaespse tpgprpagpa gdepaespse tpgpspagpt rdepakagea 661 aelqdaeves saksgkp
```

P antigen family member 4 NP_001305806.1, NP_008934.1
(SEQ ID NO: 336)
```
  1 msarvrsrsr grgdggeapd vvafvapges qqeepptdnq diepgqereg tppieerkve 61 gdcqemdlek trsergdgsd vkektppnpk haktkeagdg qp
```

Paired box protein Pax-3, isoform PAX3a NP_000429.2
(SEQ ID NO: 337)
```
  1 mttlagavpr mmrpgpgqny prsgfplevs tplgggrvng lggvfingrp lpnhirhkiv 61 emahhgirpc visrqlrvsh gcvskilcry getgsirpga iggskpkqvt tpdvekkiee 121 ykrenpgmfs weirdkllkd avcdrntvps vssisrilrs kfgkgeeeea dlerkeaees 181 ekkakhsidg ilsergkrwr lgrrtcwvtw rasas
```

-continued

Paired box protein Pax-3, isoform PAX3i NP_001120838.1
(SEQ ID NO: 338)
  1 mttlagavpr mmrpgpgqny prsgfplevs tplgggrvng lggvfingrp lpnhirhkiv 61 emahhgirpc visrqlrvsh gcvskilcry getgsirpga iggskpkvtt pdvekkieey 121 krenpgmfsw eirdkllkda vcdrntvpsv ssisrilrsk fgkgeeeead lerkeaeese 181 kkakhsidgi lserasapqs degsdidsep dlplkrkgrr srttftaeql eelerafert 241 hypdiytree laqrakltea rvqvwfsnrr arwrkgagan qlmafnhlip ggfpptampt 301 lptyqlsets yqptsipqav sdpsstvhrp qplppstvhq stipsnpdss sayclpstrh 361 gfssytdsfv ppsgpsnpmn ptignglspq vmglltnhgg vphqpqtdya lspltgglep 421 tttvsascsq rldhmkslds lptsgsycpp tysttgysmd pvtgyqyggy gqsafhylkp 481 dia Paired box protein Pax-3, isoform PAX3b NP_039230.1
(SEQ ID NO: 339)
  1 mttlagavpr mmrpgpgqny prsgfplevs tplgggrvng lggvfingrp lpnhirhkiv 61 emahhgirpc visrqlrvsh gcvskilcry getgsirpga iggskpkqvt tpdvekkiee 121 ykrenpgmfs weirdkllkd avcdrntvps vssisrilrs kfgkgeeeea dlerkeaees 181 ekkakhsidg ilsergkalv sgvssh Paired box protein Pax-3, isoform PAX3 NP_852122.1
(SEQ ID NO: 340)
  1 mttlagavpr mmrpgpgqny prsgfplevs tplgggrvng lggvfingrp lpnhirhkiv 61 emahhgirpc visrqlrvsh gcvskilcry getgsirpga iggskpkqvt tpdvekkiee 121 ykrenpgmfs weirdkllkd avcdrntvps vssisrilrs kfgkgeeeea dlerkeaees 181 ekkakhsidg ilserasapq sdegsdidse pdlplkrkgr rsrttftaeq leelerafer 241 thypdiytre elaqraklte arvqvwfsnr rarwrkgaga nqlmafnhli pggfpptamp 301 tlptyqlset syqptsipqa vsdpsstvhr pqplppstvh qstipsnpds ssayclpstr 361 hgfssytdsf vppsgpsnpm nptignglsp qvmglltnhg gvphqpqtdy alspltggle 421 ptttvsascs qrldhmksld slptsgsycp ptysttgysm dpvtgyqygq ygqskpwtf Paired box protein Pax-3, isoform PAX3d NP_852123.1
(SEQ ID NO: 341)
  1 mttlagavpr mmrpgpgqny prsgfplevs tplgggrvng lggvfingrp lpnhirhkiv 61 emahhgirpc visrqlrvsh gcvskilcry getgsirpga iggskpkqvt tpdvekkiee 121 ykrenpgmfs weirdkllkd avcdrntvps vssisrilrs kfgkgeeeea dlerkeaees 181 ekkakhsidg ilserasapq sdegsdidse pdlplkrkgr rsrttftaeq leelerafer 241 thypdiytre elaqraklte arvqvwfsnr rarwrkgaga nqlmafnhli pggfpptamp 301 tlptyqlset syqptsipqa vsdpsstvhr pqplppstvh qstipsnpds ssayclpstr 361 hgfssytdsf vppsgpsnpm nptignglsp qvmglltnhg gvphqpqtdy alspltggle 421 ptttvsascs qrldhmksld slptsgsycp ptysttgysm dpvtgyqygq ygqsafhylk 481 pdia Paired box protein Pax-3, isoform PAX3e NP_852124.1
(SEQ ID NO: 342)
  1 mttlagavpr mmrpgpgqny prsgfplevs tplgggrvng lggvfingrp lpnhirhkiv 61 emahhgirpc visrqlrvsh gcvskilcry getgsirpga iggskpkqvt tpdvekkiee 121 ykrenpgmfs weirdkllkd avcdrntvps vssisrilrs kfgkgeeeea dlerkeaees 181 ekkakhsidg ilserasapq sdegsdidse pdlplkrkgr rsrttftaeq leelerafer 241 thypdiytre elaqraklte arvqvwfsnr rarwrkgaga nqlmafnhli pggfpptamp

```
301 tlptyqlset syqptsipqa vsdpsstvhr pqplppstvh qstipsnpds ssayclpstr 361 hgfssytdsf vppsgpsnpm nptignglsp qvmglltnhg gvphqpqtdy alspltggle 421 ptttvsascs qrldhmksld slptsgsycp ptysttgysm dpvtgyqygq ygqsafhylk 481 pdiawfqill ntfdkssgee edleq
```

Paired box protein Pax-3, isoform PAX3h NP_852125.1

(SEQ ID NO: 343)

```
  1 mttlagavpr mmrpgpgqny prsgfplevs tplgggrvng lggvfingrp lpnhirhkiv 61 emahhgirpc visrqlrvsh gcvskilcry getgsirpga iggskpkqvt tpdvekkiee 121 ykrenpgmfs weirdkllkd avcdrntvps vssisrilrs kfgkgeeeea dlerkeaees 181 ekkakhsidg ilserasapq sdegsdidse pdlplkrkgr rsrttftaeq leelerafer 241 thypdiytre elaqraklte arvqvwfsnr rarwrkgaga nqlmafnhli pggfpptamp 301 tlptyqlset syqptsipqa vsdpsstvhr pqplppstvh qstipsnpds ssayclpstr 361 hgfssytdsf vppsgpsnpm nptignglsp qvpfiissqi slgfksf
```

Paired box protein Pax-3, isoform PAX3g NP_852126.1

(SEQ ID NO: 344)

```
  1 mttlagavpr mmrpgpgqny prsgfplevs tplgggrvng lggvfingrp lpnhirhkiv 61 emahhgirpc visrqlrvsh gcvskilcry getgsirpga iggskpkqvt tpdvekkiee 121 ykrenpgmfs weirdkllkd avcdrntvps vssisrilrs kfgkgeeeea dlerkeaees 181 ekkakhsidg ilserasapq sdegsdidse pdlplkrkgr rsrttftaeq leelerafer 241 thypdiytre elaqraklte arvqvwfsnr rarwrkgaga nqlmafnhli pggfpptamp 301 tlptyqlset syqptsipqa vsdpsstvhr pqplppstvh qstipsnpds ssayclpstr 361 hgfssytdsf vppsgpsnpm nptignglsp qvpfiissqi srk
```

Paired box protein Pax-5, isoform 1 NP_057953.1

(SEQ ID NO: 345)

```
  1 mdleknyptp rtsrtghggv nqlggvfvng rplpdvvrqr ivelahqgvr pcdisrqlry 61 shgcvskilg ryyetgsikp gviggskpkv atpkvvekia eykrqnptmf aweirdrlla 121 ervcdndtvp syssinriir tkvqqppnqp vpasshsivs tgsvtqvssv stdsagssys 181 isgilgitsp sadtnkrkrd egiqespvpn ghslpgrdfl rkqmrgdlft qqqlevldry 241 ferqhysdif tttepikpeq tteysamasl aggldddmkan lasptpadig ssvpgpqsyp 301 ivtgrdlast tlpgypphvp pagqgsysap tltgmvpgse fsgspyshpq yssyndswrf 361 pnpgllgspy yysaaargaa ppaaataydr h
```

Paired box protein Pax-5, isoform 2 NP_001267476.1

(SEQ ID NO: 346)

```
  1 mdleknyptp rtsrtghggv nqlggvfvng rplpdvvrqr ivelahqgvr pcdisrqlry 61 shgcvskilg ryyetgsikp gviggskpkv atpkvvekia eykrqnptmf aweirdrlla 121 ervcdndtvp syssinriir tkvqqppnqp vpasshsivs tgsvtqvssv stdsagssys 181 isgilgitsp sadtnkrkrd egiqespvpn ghslpgrdfl rkqmrgdlft qqqlevldry 241 ferqhysdif tttepikpeq tteysamasl aggldddmkan lasptpadig ssvpgpqsyp 301 ivtgsefsgs pyshpqyssy ndswrfpnpg llgspyyysa aargaappaa ataydrh
```

Paired box protein Pax-5, isoform 3 NP_001267477.1

(SEQ ID NO: 347)

```
  1 mdleknyptp rtsrtghggv nqlggvfvng rplpdvvrqr ivelahqgvr pcdisrqlry 61 shgcvskilg ryyetgsikp gviggskpkv atpkvvekia eykrqnptmf aweirdrlla 121 ervcdndtvp syssinriir tkvqqppnqp vpasshsivs tgsvtqvssv stdsagssys 181 isgilgitsp sadtnkrkrd egiqespvpn ghslpgrdfl rkqmrgdlft qqqlevldry 241 ferqhysdif tttepikpeq tteysamasl aggldddmkan lasptpadig ssvpgpqsyp
```

-continued

```
301 ivtgrdlast tlpgypphvp pagqgsysap tltgmvpgsp yyysaaarga appaaatayd 361 rh
```

Paired box protein Pax-5, isoform 4 NP_001267478.1
(SEQ ID NO: 348)
```
  1 mdleknyptp rtsrtghggv nqlggvfvng rplpdvvrqr ivelahqgvr pcdisrqlry 61 shgcvskilg ryyetgsikp gviggskpkv atpkvvekia eykrqnptmf aweirdrlla 121 ervcdndtvp syssinriir tkvqqppnqp vpasshsivs tgsvtqvssv stdsagssys 181 isgilgitsp sadtnkrkrd egiqespvpn ghslpgrdfl rkqmrgdlft qqqlevldry 241 ferqhysdif tttepikpeq gvsfpgvpta tlsiprtttp ggsptrgcla pptiialppe 301 epphlqpplp mtvtdpwsqa gtkh
```

Paired box protein Pax-5, isoform 5 NP_001267479.1
(SEQ ID NO: 349)
```
  1 mdleknyptp rtsrtghggv nqlggvfvng rplpdvvrqr ivelahqgvr pcdisrqlry 61 shgcvskilg ryyetgsikp gviggskpkv atpkvvekia eykrqnptmf aweirdrlla 121 ervcdndtvp syssinriir tkvqqppnqp vpasshsivs tgsvtqvssv stdsagssys 181 isgilgitsp sadtnkrkrd egiqespvpn ghslpgrdfl rkqmrgdlft qqqlevldry 241 ferqhysdif tttepikpeq apptiialpp eepphlqppl pmtvtdpwsq agtkh
```

Paired box protein Pax-5, isoform 6 NP_001267480.1
(SEQ ID NO: 350)
```
  1 mfaweirdrl laervcdndt vpsyssinri irtkvqqppn qpvpasshsi vstgsvtqvs 61 systdsagss ysisgilgit spsadtnkrk rdegiqespv pnghslpgrd flrkqmrgdl 121 ftqqqlevld rvferqhysd iftttepikp eqtteysama slaggldddmk anlasptpad 181 igssvpgpqs ypivtgspyy ysaaargaap paaataydrh
```

Paired box protein Pax-5, isoform 7 NP_001267481.1
(SEQ ID NO: 351)
```
  1 mdleknyptp rtsrtghggv nqlggvfvng rplpdvvrqr ivelahqgvr pcdisrqlry 61 shgcvskilg ryyetgsikp gviggskpkv atpkvvekia eykrqnptmf aweirdrlla 121 ervcdndtvp syssinriir tkvqqppnqp vpasshsivs tgsvtqvssv stdsagssys 181 isgilgitsp sadtnkrkrd egiqespvpn ghslpgrdfl rkqmrgdlft qqqlevldry 241 ferqhysdif tttepikpeq tteysamasl aggldddmkan lasptpadig ssvpgpqsyp 301 ivtgspyyys aaargaappa ataydrh
```

Paired box protein Pax-5, isoform 8 NP_001267482.1
(SEQ ID NO: 352)
```
  1 mdleknyptp rtsrtghggv nqlggvfvng rplpdvvrqr ivelahqgvr pcdisrqlry 61 shgcvskilg ryyetgsikp gviggskpkv atpkvvekia eykrqnptmf aweirdrlla 121 ervcdndtvp syssinriir tkvqqppnqp vpasshsigi qespvpnghs lpgrdflrkg 181 mrgdlftqqq levldrvfer qhysdifttt epikpeqtte ysamaslagg lddmkanlas 241 ptpadigssv pgpqsypivt grdlasttlp gypphvppag qgsysaptlt gmvpgspyyy 301 saaargaapp aaataydrh
```

Paired box protein Pax-5, isoform 9 NP_001267483.1
(SEQ ID NO: 353)
```
  1 mdleknyptp rtsrtghggv nqlggvfvng rplpdvvrqr ivelahqgvr pcdisrqlry 61 shgcvskilg ryyetgsikp gviggskpkv atpkvvekia eykrqnptmf aweirdrlla 121 ervcdndtvp syssinriir tkvqqppnqp vpasshsigi qespvpnghs lpgrdflrkg 181 mrgdlftqqq levldrvfer qhysdifttt epikpeqtte ysamaslagg lddmkanlas
```

```
241 ptpadigssv pgpqsypivt grdlasttlp gypphvppag qgsysaptlt gmvpgsefsg 301 spyshpqyss yndswrfpnp gllgspyyys aaargaappa aataydrh
```

Paired box protein Pax-5, isoform 10 NP_001267484.1
(SEQ ID NO: 354)
```
  1 mdleknyptp rtsrtghggv nqlggvfvng rplpdvvrqr ivelahqgvr pcdisrqlry 61 shgcvskilg riirtkvqqp pnqpvpassh sivstgsvtq vssystdsag ssysisgilg 121 itspsadtnk rkrdegiqes pvpnghslpg rdflrkqmrg dlftqqqlev ldrvferqhy 181 sdiftttepi kpeqtteysa maslaggldd mkanlasptp adigssvpgp qsypivtgse 241 fsgspyshpq yssyndswrf pnpgllgspy yysaaargaa ppaaataydr h
```

Paired box protein Pax-5, isoform 11 NP_001267485.1
(SEQ ID NO: 355)
```
  1 mfaweirdrl laervcdndt vpsyssinri irtkvqqppn qpvpasshsi vstgsvtqvs 61 systdsagss ysisgilgit spsadtnkrk rdegiqespv pnghslpgrd flrkgmrgdl 121 ftqqqlevld rvferqhysd iftttepikp eqtteysama slaggldmk anlasptpad 181 igssvpgpqs ypivtgrdla sttlpgypph vppagqgsys aptltgmvpg sefsgspysh 241 pqyssyndsw rfpnpgllgs pyyysaaarg aappaaatay drh
```

Platelet-derived growth factor receptor beta, isoform 1 NP_002600.1
(SEQ ID NO: 356)
```
  1 mrlpgampal alkgelllls llllllepgis qglvvtppgp elvinvsstf vltcsgsapv 61 vwermsgepp qemakagdgt fssvltltnl tgldtgeyfc thndsrglet derkrlyifv 121 pdptvgflpn daeelfiflt eiteitiper vtdpqlvvtl hekkgdvalp vpydhqrgfs 181 gifedrsyic kttigdrevd sdayvvyrlq vssinvsvna vqtvvrqgen itlmcivign 241 evvnfewtyp rkesgrlvep vtdflldmpy hirsilhips aeledsgtyt cnvtesvndh 301 qdekainitv vesgyvrllg evgtlgfael hrsrtlqvvf eaypppptvlw fkdnrtlgds 361 sageialstr nvsetryvse ltivrvkvae aghytmrafh edaevqlsfq lqinvpvrvl 421 elseshpdsg eqtvrcrgrg mpqpniiwsa crdlkrcpre lpptllgnss eeesqletnv 481 tyweeeqefe vvstlrlqhv drplsvrctl rnavgqdtge vivvphslpf kvvvisaila 541 lvvltiisli ilimlwqkkp ryeirwkvie syssdgheyi yvdpmqlpyd stwelprdql 601 vlgrtlgsga fgqvveatah glshsqatmk vavkmlksta rssekqalms elkimshlgp 661 hlnvvnllga ctkggpiyii teycrygdlv dylhrnkhtf lqhhsdkrrp psaelysnal 721 pvglplpshv sltgesdggy mdmskdesvd yvpmldmkgd vkyadiessn ymapydnyvp 781 sapertcrat linespvlsy mdlvgfsyqv angmeflask ncvhrdlaar nvlicegklv 841 kicdfglard imrdsnyisk gstflplkwm apesifnsly ttlsdvwsfg illweiftlg 901 gtpypelpmn eqfynaikrg yrmaqpahas deiyeimqkc weekfeirpp fsqlvlller 961 llgegykkky qqvdeeflrs dhpailrsqa rlpgfhglrs pldtssvlyt avqpnegdnd 1021 yiiplpdpkp evadegpleg spslasstln evntsstisc dsplepqdep epepqlelqv 1081 epepeleglp dsgcpaprae aedsfl
```

Platelet-derived growth factor receptor beta, isoform 2
NP_001341945.1
(SEQ ID NO: 357)
```
  1 msgeppqema kaqdgtfssv ltltnitgld tgeyfcthnd srgletderk rlyifvpdpt 61 vgflpndaee lfifltteite itipervtdp qlvvtlhekk gdvalpvpyd hqrgfsgife 121 drsyickti gdrevdsday yvyrlqvssi nvsvnavqtv vrqgenitlm civignevvn 181 fewtyprkes grlvepvtdf lldmpyhirs ilhipsaele dsgtytcnvt esvndhqdek 241 ainitvvesg yvrllgevgt lqfaelhrsr tlqvvfeayp pptvlwfkdn rtlgdssage
```

-continued

```
 301 ialstrnvse tryvseltiv rvkvaeaghy tmrafhedae vqlsfqlqin vpvrvlelse 361 shpdsgeqtv rcrgrgmpqp niiwsacrdl krcprelppt llgnsseees qletnvtywe 421 eeqefevvst lrlqhvdrpl svrctlrnav gqdtgevivv phslpfkvvv isailalvvl 481 tiisliilim lwqkkpryei rwkviesyss dgheyiyvdp mqlpydstwe lprdqlvlgr 541 tlgsgafgqv veatahglsh sqatmkvavk mlkstarsse kqalmselki mshlgphlnv 601 vnllgactkg gpiyiiteyc rygdlvdylh rnkhtflqhh sdkrrppsae lysnalpvgl 661 plpshvsltg esdggymdms kdesvdyvpm ldmkgdvkya diessnymap ydnyvpsape 721 rtcratline spvlsymdlv gfsyqvangm eflaskncvh rdlaarnvli cegklvkicd 781 fglardimrd snyiskgstf lplkwmapes ifnslyttls dvwsfgillw eiftlggtpy 841 pelpmneqfy naikrgyrma qpahasdeiy eimqkcweek feirppfsql vlllerllge 901 gykkkyqqvd eeflrsdhpa ilrsgarlpg fhglrspldt ssvlytavqp negdndyiip 961 lpdpkpevad egplegspsl asstlnevnt sstiscdspl epqdepepep glelqvepep 1021 eleglpdsgc papraeaeds fl
```

Platelet-derived growth factor receptor beta, isoform 3
NP_001341946.1

(SEQ ID NO: 358)
```
   1 mitnvaflvs lrteatsakp plgtgrwilm ptmstdsrvs plsglmlsry ssinvsvnav 61 qtvvrqgeni tlmcivigne vvnfewtypr kesgrlvepv tdflldmpyh irsilhipsa 121 eledsgtytc nvtesvndhq dekainitvv esgyvrllge vgtlgfaelh rsrtlqvvfe 181 ayppptvlwf kdnrtlgdss ageialstrn vsetryvsel tivrvkvaea ghytmrafhe 241 daevqlsfql qinvpvrvle lseshpdsge qtvrcrgrgm pqpniiwsac rdlkrcprel 301 pptllgnsse eesqletnvt yweeeqefev vstlrlqhvd rplsvrctlr navgqdtgev 361 ivvphslpfk vvvisailal vvltiislii limlwqkkpr yeirwkvies vssdgheyiy 421 vdpmqlpyds twelprdqlv lgrtlgsgaf gqvveatahg lshsqatmkv avkmlkstar 481 ssekqalmse lkimshlgph lnvvnllgac tkggpiyiit eycrygdlvd ylhrnkhtfl 541 qhhsdkrrpp saelysnalp vglplpshvs ltgesdggym dmskdesvdy vpmldmkgdv 601 kyadiessny mapydnyvps apertcratl inespvlsym dlvgfsyqva ngmeflaskn 661 cvhrdlaarn vlicegklvk icdfglardi mrdsnyiskg stflplkwma pesifnslyt 721 tlsdvwsfgi llweiftlgg tpypelpmne qfynaikrgy rmaqpahasd eiyeimqkcw 781 eekfeirppf sqlvlllerl lgegykkkyq qvdeeflrsd hpailrsqar lpgfhglrsp 841 ldtssvlyta vqpnegdndy iiplpdpkpe vadegplegs pslasstlne vntsstiscd 901 splepqdepe pepqlelqve pepeleglpd sgcpapraea edsfl
```

Placenta-specific protein 1 precursor NP_001303816.1,
NP_001303817.1, NP_001303818.1, NP_068568.1

(SEQ ID NO: 359)
```
   1 mkvfkfiglm illtsafsag sggspmtvlc sidwfmvtvh pfmlnndvcv hfhelhlglg 61 cppnhvqpha yqftyrvtec girakaysqd mviysteihy sskgtpskfv ipvscaapqk 121 spwltkpcsm rvasksrata qkdekcyevf slsqssqrpn cdcppcvfse eehtqvpchq 181 agageaqplq pshfldised wslhtddmig sm
```

Melanoma antigen preferentially expressed in tumors, isoform a
NP_001278644.1, NP_001278645.1, NP_006106.1, NP_996836.1,
NP_996837.1, NP_996838.1, NP_996839.1

(SEQ ID NO: 360)
```
   1 merrrlwgsi gsryismsvw tsprrlvela gqsllkdeal aiaalellpr elfpplfmaa 61 fdgrhsqtlk amvqawpftc lplgvlmkgq hlhletfkav ldgldvllaq evrprrwklq
```

-continued

```
 121  vldlrknshq dfwtvwsgnr aslysfpepe aaqpmtkkrk vdglsteaeq pfipvevlvd 181  lflkegacde lfsyliekvk rkknvlrlcc kklkifampm qdikmilkmv qldsiedlev 241  tctwklptla kfspylgqmi nlrrlllshi hassyispek eegyiaqfts qflslqclqa 301  lyvdslfflr grldqllrhv mnpletlsit ncrlsegdvm hlsqspsysq lsvlslsgvm 361  ltdvspeplq alleresatl qdlvfdecgi tddqllallp slshcsqltt lsfygnsisi 421  salgsllghl iglsnithvl ypvplesyed ihgtlhlerl aylharlrel lcelgrpsmv 481  wlsanpcphc gdrtfydpep ilcpcfmpn
```

Melanoma antigen preferentially expressed in tumors, isoform b
NP_001278646.1, NP_001278648.1, NP_001305055.1, NP_001305056.1
(SEQ ID NO: 361)

```
   1  msvwtsprrl velaggsllk dealaiaale llprelfppl fmaafdgrhs qtlkamvqaw 61  pftclplgvl mkgqhlhlet fkavldgldv llagevrprr wklqvldlrk nshqdfwtvw 121  sgnraslysf pepeaaqpmt kkrkvdglst eaegpfipve vlvdlflkeg acdelfsyli 181  ekvkrkknvl rlcckklkif ampmqdikmi lkmvqldsie dlevtctwkl ptlakfspyl 241  gqminlrrll lshihassyi spekeeqyia qftsqflslq clqalyvdsl fflrgrldql 301  lrhvmnplet lsitncrlse gdvmhlsgsp sysqlsvlsl sgvmltdvsp eplqallera 361  satlqdlvfd ecgitddqll allpslshcs qlttlsfygn sisisalqsl lqhliglsnl 421  thvlypvple syedihgtlh lerlaylhar lrellcelgr psmvwlsanp cphcgdrtfy 481  dpepilcpcf mpn
```

Phosphatidylinositol 3,4,5-triphosphate-dependent Rac exchanger 2
protein, isoform a NP_079146.2
(SEQ ID NO: 362)

```
   1  msedsrgdsr aesakdlekq lrlrvcvlse lqkterdyvg tleflvsafl hrmnqcaask 61  vdknvteetv kmlfsniedi lavhkeflkv veeclhpepn aggevgtcfl hfkdkfriyd 121  eycsnhekaq klllelnkir tirtfllncm llggrkntdv plegylvtpi grickyplil 181  kellkrtprk hsdyaavmea lqamkavcsn ineakrqmek levleewqsh iegwegsnit 241  dtctemlmcg vllkissgni gervfflfdn llvyckrkhr rlknskastd ghrylfrgri 301  ntevmevenv ddgtadfhss ghivvngwki hntaknkwfv cmaktpeekh ewfeailker 361  errkglklgm eqdtwvmise qgeklykmmc rqgnlikdrk rklttfpkcf lgsefvswll 421  eigeihrpee gvhlggalle ngiihhvtdk hqfkpeqmly rfryddgtfy prnemqdvis 481  kgvrlycrlh slftpvirdk dyhlrtyksv vmanklidwl iaggdcrtre eamifgvglc 541  dngfmhhvle ksefkdepll frffsdeeme gsnmkhrlmk hdlkvvenvi aksllikksne 601  gsygfgledk nkvpiiklve kgsnaemagm evgkkifain gdlvfmrpfn evdcflkscl 661  nsrkplrvlv stkpretvki pdsadglgfq irgfgpsvvh avgrgtvaaa aglhpgqcii 721  kvnginvske thasviahvt acrkyrrptk qdsigwvyns iesagedlqk shskppgdea 781  gdafdckvee vidkfntmai idgkkehvsl tvdnvhleyg vvyeydstag ikcnvvekmi 841  epkgffslta kilealaksd ehfvqnctsl nslneviptd lgskfsalcs eriehlcgri 901  ssykkfsrvl knrawptfkq akskisplhs sdfcptnchv nvmevsypkt stslgsafgv 961  qldsrkhnsh dkenksseqg klspmvyiqh tittmaapsg lslgqqdghg lryllkeedl 1021  etqdiyqkll gklqtalkev emcvcqiddl lssityspkl erktsegiip tdsdnekger 1081  nskrvcfnva gdeqedsghd tisnrdsysd cnsnrnsias ftsicssqcs syfhsdemds 1141  gdelplsvri shdkqdkihs clehlfsqvd sitnllkgqa vvrafdqtky ltpgrglqef 1201  qqemepklsc pkrlrlhikg dpwnlpssvr tlagnirkfv eevkcrllla lleysdsetq 1261  lrrdmvfcqt lvatvcafse qlmaalnqmf dnskenemet weasrrwldq ianagvlfhf
```

```
1321  qsllspnitd eqamledtiv alfdlekvsf yfkpseeepl vanvpltyqa egsrgalkvy 1381  fyidsyhfeq lpqrlknggg fkihpvlfaq alesmegyyy rdnvsveefq aqinaaslek 1441  vkgynqklra fyldksnspp nstskaayvd klmrpinald elyrlvasfi rskrtaacan 1501  tacsasgvgl lsysselcnr lgachiimcs sgvhrctlsv tlegaiilar shglppryim 1561  qatdvmrkqg arvqntaknl gvrdrtpqsa prlyklcepp ppagee
```

Phosphatidylinositol 3,4,5-triphosphate-dependent Rac exchanger 2 protein, isoform b NP_079446.3

(SEQ ID NO: 363)

```
  1  msedsrgdsr aesakdlekq lrlrvcvlse lqkterdyvg tleflvsafl hrmnqcaask 61  vdknvteetv kmlfsniedi lavhkeflkv veeclhpepn aggevgtcfl hfkdkfriyd 121  eycsnhekaq klllelnkir tirtfllncm llggrkntdv plegylvtpi grickyplil 181  kellkrtprk hsdyaavmea lqamkavcsn ineakrqmek levleewqsh iegwegsnit 241  dtctemlmcg vllkissgni gervfflfdn llvyckrkhr rlknskastd ghrylfrgri 301  ntevmevenv ddgtadfhss ghivvngwki hntaknkwfv cmaktpeekh ewfeailker 361  errkglklgm eqdtwvmise qgeklykmmc rqgnlikdrk rklttfpkcf lgsefvswll 421  eigeihrpee gvhlggalle ngiihhvtdk hqfkpeqmly rfryddgtfy prnemqdvis 481  kgvrlycrlh slftpvirdk dyhlrtyksv vmanklidwl iaggdcrtre eamifgvglc 541  dngfmhhvle ksefkdepll frffsdeeme gsnmkhrlmk hdlkvvenvi akslliksne 601  gsygfgledk nkvpiiklve kgsnaemagm evgkkifain gdlvfmrpfn evdcflkscl 661  nsrkplrvlv stkpretvki pdsadglgfq irgfgpsvvh avgrgtvaaa aglhpgqcii 721  kvnginvske thasviahvt acrkyrrptk qdsigwvyns iesagedlqk shskppgdea 781  gdafdckvee vidkfntmai idgkkehvsl tvdnvhleyg vvyeydstag ikcnvvekmi 841  epkgffslta kilealaksd ehfvqnctsl nslneviptd lgskfsalcs eriehlcgri 901  ssykkvgase rfynftarha vwehsfdlhs vsstfpvpvt mefllllpppl lgisqdgrqh 961  cipedlpsqe mllaerapv
```

Protamine-2, isoform 1 NP_002753.2

(SEQ ID NO: 364)

```
  1  mvryrvrsls ershevyrqq lhgqegghhg qeeqglspeh vevyerthgq shyrrrhcsr 61  rrlhrihrrq hrscrrrkrr scrhrrrhrr gcrtrkrtcr rh
```

Protamine-2, isoform 2 NP_001273285.1

(SEQ ID NO: 365)

```
  1  mvryrvrsls ershevyrqq lhgqegghhg qeeqglspeh vevyerthgq shyrrrhcsr 61  rrlhrihrrq hrscrrrkrr scrhrrrhrr eslgdpinqn flsqkaaepg rehaegtklp 121  gpltpswklr ksrpkhqvrp
```

Protamine-2, isoform 3 NP_001273286.1

(SEQ ID NO: 366)

```
  1  mvryrvrsls ershevyrqq lhgqegghhg qeeqglspeh vevyerthgq shyrrrhcsr 61  rrlhrihrrq hrscrrh
```

Protamine-2, isoform 4 NP_001273287.1

(SEQ ID NO: 367)

```
  1  mvryrvrsls ershevyrqq lhgqegghhg geegglspeh vevyerthgq shyrrrhcsr 61  rrlhrihrrq hrscrrrkrr scrhrrrhrr epgrehaegt klpgpltpsw klrksrpkhq 121  vrp
```

Protamine-2, isoform 5 NP_001273288.1

(SEQ ID NO: 368)

```
  1  mvryrvrsls ershevyrqq lhgqegghhg geegglspeh vevyerthgq shyrrrhcsr 61  rrlhrihrrq hrscrrrkrr scrhrrrhrr glpapppcpa cp
```

-continued

```
Progranulin NP_002078.1
                                                          (SEQ ID NO: 369)
    1 mwtivswval taglvagtrc pdgqfcpvac cldpggasys ccrplldkwp ttlsrhlggp 61 cqvdahcsag hsciftvsgt ssccpfpeav acgdghhccp rgfhcsadgr scfqrsgnns 121 vgaiqcpdsq fecpdfstcc vmvdgswgcc pmpqascced rvhccphgaf cdlvhtrcit 181 ptgthplakk lpaqrtnrav alsssvmcpd arsrcpdgst ccelpsgkyg ccpmpnatcc 241 sdhlhccpqd tvcdliqskc lskenattdl ltklpahtvg dvkcdmevsc pdgytccrlq 301 sgawgccpft qavccedhih ccpagftcdt qkgtceqgph qvpwmekapa hslpdpgal 361 krdvpcdnvs scpssdtccq ltsgewgccp ipeavccsdh qhccpqgytc vaeggcqrgs 421 eivaglekmp arraslshpr digcdqhtsc pvgqtccpsl ggswaccqlp havccedrqh 481 ccpagytcnv karscekevv saqpatflar sphvgvkdve cgeghfchdn qtccrdnrqg 541 waccpyrqgv ccadrrhccp agfrcaargt kclrreaprw daplrdpalr qll Myeloblastin precursor NP_002768.3
                                                          (SEQ ID NO: 370)
    1 mahrppspal asvllallls gaaraaeivg gheaqphsrp ymaslqmrgn pgshfcggtl 61 ihpsfvltaa hclrdipqrl vnvvlgahnv rtgeptqqhf svaqvflnny daenklndvl 121 liqlsspanl sasvatvqlp qqdqpvphgt qclamgwgry gandppaqvl gelnvtvvtf 181 fcrphnictf vprrkagicf gdsggplicd giiggidsfv iwgcatrlfp dfftrvalyv 241 dwirstlrry eakgrp Prostate stem cell antigen preportein NP_005663.2
                                                          (SEQ ID NO: 371)
    1 maglalqpgt allcysckaq vsnedclqve nctqlgeqcw tariravgll tviskgcsln 61 cvddsqdyyv gkknitccdt dlcnasgaha lqpaaailal lpalglllwg pgql Ras-related C3 botulinum toxin substrate 1 isoform Rac1b
NP_061485.1
                                                          (SEQ ID NO: 372)
    1 mqaikcvvvg dgavgktcll isyttnafpg eyiptvfdny sanvmvdgkp vnlglwdtag 61 qedydrlrpl sypqtvgety gkditsrgkd kpiadvflic fslvspasfe nvrakwypev 121 rhhcpntpii lvgtkldlrd dkdtieklke kkltpitypq glamakeiga vkylecsalt 181 grglktvfde airavlcppp vkkrkrkcll l Regenerating islet-derived protein 3-alpha precursor NP_002571.1,
NP_620354.1, NP_620355.1
                                                          (SEQ ID NO: 373)
    1 mlppmalpsv swmllsclml lsqvggeepq relpsarirc pkgskaygsh cyalflspks 61 wtdadlacqk rpsgnlvsvl sgaegsfvss lvksignsys yvvwiglhdpt qgtepngegw 121 ewsssdvmny fawernpsti sspghcasls rstaflrwkd yncnvrlpyv ckftd Regulator of G-protein signaling 5, isoform 1 NP_003608.1
                                                          (SEQ ID NO: 374)
    1 mckglaalph sclerakeik iklgillqkp dsvgdlvipy nekpekpakt qktsldealq 61 wrdsldkllq nnyglasfks flksefseen lefwiacedy kkikspakma ekakqiyeef 121 igteapkevn idhftkditm knlvepslss fdmagkriha lmekdslprf vrsefyqeli 181 k Regulator of G-protein signaling 5, isoform 2 NP_001182232.1,
NP_001241677.1
                                                          (SEQ ID NO: 375)
    1 maekakqiye efigteapke vnidhftkdi tmknlvepsl ssfdmagkri halmekdslp 61 rfvrsefyqe lik Regulator of G-protein signaling 5, isoform 3 NP_001241678.1
                                                          (SEQ ID NO: 376)
    1 mckglaalph sclerakeik iklgillqkp dsvgdlvipy nekpekpakt qktsldealq
```

-continued

```
 61 wrdsldkllq nnyglasfks flksefseen lefwiacedy kkikspakma ekakqiyeef 121 igteapkevg lwvnidhftk ditmknlvep slssfdmaqk rihalmekds lprfvrsefy 181 qelik
```

Rho-related GTP-binding protein RhoC precursor NP_001036143.1,
NP_001036144.1, NP_786886.1

(SEQ ID NO: 377)

```
  1 maairkklvi vgdgacgktc llivfskdqf pevyvptvfe nyiadievdg kqvelalwdt 61 aggedydrlr plsypdtdvi lmcfsidspd slenipekwt pevkhfcpnv piilvgnkkd 121 lrqdehtrre lakmkqepvr seegrdmanr isafgylecs aktkegvrev fematraglq 181 vrknkrrrgc pil
```

Sarcoma antigen 1 NP_061136.2

(SEQ ID NO: 378)

```
  1 mgasplqtsq ptppeelhaa ayvftndgqq mrsdevnlva tghqskkkhs rkskrhsssk 61 rrksmsswld kqedaavths iceerinngq pvadnvlsta ppwpdatiah nireermeng 121 qsrtdkvlst appqlvhmaa agipsmstrd lhstvthnir eermengqpq pdnvlstgpt 181 glinmaatpi pamsardlya tvthnvceqk menvqpapdn vlltlrprri nmtdtgispm 241 strdpyatit ynvpeekmek gqpqpdnils tastglinva gagtpaistn glystvphnv 301 ceekmendqp qpnnvlstvq pviiyltatg ipgmntrdqy atithnvcee rvvnnqplps 361 nalstvlpgl aylatadmpa mstrdqhati ihnlreekkd nsqptpdnvl savtpelinl 421 agagippmst rdqyatvnhh vhearmengq rkqdnvlsnv lsglinmaga sipamssrdl 481 yatithsvre ekmesgkpqt dkvisndapq lghmaaggip smstkdlyat vtqnvheerm 541 ennqpqpsyd lstvlpglty ltvagipams trdqyatvth nvheekikng qaasdnvfst 601 vppafinmaa tgvssmstrd qyaavthnir eekinnsqpa pgnilstapp wlrhmaaagi 661 sstitrdlyv tathsvheek mtngqqapdn slstvppgci nlsgagiscr strdlyatvi 721 hdigeeemen dqtppdgfls nsdspelinm tghcmppnal dsfshdftsl skdellykpd 781 snefavgtkn ysysagdppv tvmslvetvp ntpgispama kkinddikyq lmkevrrfgq 841 nyerifille evqgsmkvkr qfveftikea arfkkvvliq qlekalkeid shchlrkvkh 901 mrkr
```

Squamous cell carcinoma antigen recognized by T-cells 3 NP_055521.1

(SEQ ID NO: 379)

```
  1 mataaetsas epeaeskagp kadgeedevk aartrrkvls ravaaatykt mgpawdqqee 61 gvsesdgdey amassaessp geyeweydee eeknqleier leeqlsinvy dynchvdlir 121 llrlegeltk vrmarqkmse ifplteelwl ewlhdeisma qdgldrehvy dlfekavkdy 181 icpniwleyg qysvggigqk gglekvrsvf eralssvglh mtkglalwea yrefesaive 241 aarlekvhsl frrqlaiply dmeatfaeye ewsedpipes vignynkalq glekykpyee 301 allqaeaprl aeyqayidfe mkigdpariq liferalven clvpdlwiry sqyldrqlkv 361 kdlvlsvhnr airncpwtva lwsryllame rhgvdhqvis vtfekalnag figatdyvei 421 wqayldylrr rvdfkqdssk eleelraaft raleylkqev eerfnesgdp scvimqnwar 481 iearlcnnmq karelwdsim trgnakyanm wleyynlera hgdtqhcrka lhravqctsd 541 ypehvcevll tmertegsle dwdiavqkte trlarvneqr mkaaekeaal vggeeekaeg 601 rkraraekka lkkkkkirgp ekrgadedde kewgddeeeq pskrrrvens ipaagetqnv 661 evaagpagkc aavdveppsk gkekaaslkr dmpkvlhdss kdsitvfvsn lpysmgepdt 721 klrplfeacg evvqirpifs nrgdfrgycy vefkeeksal galemdrksv egrpmfvspc 781 vdksknpdfk vfrystslek hklfisglpf sctkeeleei ckahgtvkdl rlvtnragkp
```

```
841 kglayveyen esqasqavmk mdgmtikeni ikvaisnppq rkvpekpetr kapggpmllp 901 qtygargkgr tqlsllpral qrpsaaapqa engpaaapav aapaateapk msnadfaklf 961 lrk
```

Secretory leukocyte protein inhibitor NP_003055.1
(SEQ ID NO: 380)
```
  1 mkssglfpfl vllalgtlap wavegsgksf kagvcppkks aqclrykkpe cqsdwqcpgk 61 krccpdtcgi kcldpvdtpn ptrrkpgkcp vtyggclmln ppnfcemdgq ckrdlkccmg 121 mcgkscvspv ka
```

Transcription factor SOX-10 NP_008872.1
(SEQ ID NO: 381)
```
  1 maeeqdlsev elspvgseep rclspgsaps lgpdgggggs glraspgpge lgkvkkeqqd 61 geadddkfpv cireaysqvl sgydwtivpm pvrvngasks kphvkrpmna fmvwagaarr 121 kladqyphlh naelsktlgk lwrllnesdk rpfieeaerl rmqhkkdhpd ykyqprrrkn 181 gkaaggeaec pggeaegggt aaigahyksa hldrhrpgeg spmsdgnpeh psgqshgppt 241 ppttpktelq sgkadpkrdg rsmgeggkph idfgnvdige ishevmsnme tfdvaeldqy 301 lppnghpghv ssysaagygl gsalavasgh sawiskppgv alptvsppgv dakaqvktet 361 agpqgpphyt dqpstsgiay tslslphygs afpsisrpqf dysdhqpsgp yyghsgqasg 421 lysafsymgp sqrplytais dpspsgpqsh spthweqpvy ttlsrp
```

Sperm surface protein Sp17 NP_059121.1
(SEQ ID NO: 382)
```
  1 msipfsnthy ripqgfgnll egltreilre qpdnipafaa ayfesllekr ektnfdpaew 61 gskvedrfyn nhafeegepp eksdpkqees qisgkeeets vtildsseed kekeevaavk 121 iqaafrghia reeakkmktn slqneekeen k
```

Protein SSX2, isoform a NP_003138.3
(SEQ ID NO: 383)
```
  1 mngddafarr ptvgaqipek igkafddiak yfskeewekm kasekifyvy mkrkyeamtk 61 lgfkatlppf mcnkraedfq gndldndpnr gnqverpqmt fgrlqgispk impkkpaeeg 121 ndseevpeas gpqndgkelc ppgkpttsek ihersgnrea qekeerrgta hrwssqnthn 181 igrfslstsm gavhgtpkti thnrdpkggn mpgptdcvre nsw
```

Protein SSX2, isoform b NP_783629.1
(SEQ ID NO: 384)
```
  1 mngddafarr ptvgaqipek igkafddiak yfskeewekm kasekifyvy mkrkyeamtk 61 lgfkatlppf mcnkraedfq gndldndpnr gnqverpqmt fgrlqgispk impkkpaeeg 121 ndseevpeas gpqndgkelc ppgkpttsek ihersgpkrg ehawthrlre rkqlviyeei 181 sdpeedde
```

Protein SSX2, isoform c NP_001265626.1
(SEQ ID NO: 385)
```
  1 mngddafarr ptvgaqipek iqkafddiak yfskeewekm kasekifyvy mkrkyeamtk 61 lgfkatlppf mcnkraedfq gndldndpnr gnqverpqmt fgrlqgispk impkkpaeeg 121 ndseevpeas gpqndgkelc ppgkpttsek ihersgnrea qekeerrgta hrwssqnthn 181 igpkrgehaw thrlrerkql viyeeisdpe edde
```

Lactosylceramide alpha-2,3-sialyltransferase, isoform 1 NP_003887.3
(SEQ ID NO: 386)
```
  1 mrtkaagcae rrplqprtea aaapagramp seytyvklrs dcsrpslqwy traqskmrrp 61 slllkdilkc tllvfgvwil yilklnytte ecdmkkmhyv dpdhvkraqk yaqqvlqkec 121 rpkfaktsma llfehrysvd llpfvqkapk dseaeskydp pfgfrkfssk vqtllellpe 181 hdlpehlkak tcrrcvvigs ggilhglelg htlnqfdvvi rinsapvegy sehvgnktti
```

-continued

```
241 rmtypegapl sdleyysndl fvavlfksvd fnwlqamvkk etlpfwvrlf fwkqvaekip 301 lqpkhfriln pviiketafd ilgysepqsr fwgrdknvpt igviavvlat hlcdevslag 361 fgydlnqprt plhyfdsqcm aamnfqtmhn vttetkfllk lvkegvvkdl sggidref
```

Lactosylceramide alpha-2,3-sialyltransferase, isoform 2
NP_001035902.1

(SEQ ID NO: 387)

```
  1 masvpmpsey tyvklrsdcs rpslqwytra gskmrrpsll lkdilkctll vfgvwilyil 61 klnytteecd mkkmhyvdpd hvkraqkyaq qvlqkecrpk faktsmallf ehrysvdllp 121 fvqkapkdse aeskydppfg frkfsskvqt llellpehdl pehlkaktcr rcvvigsggi 181 lhglelghtl nqfdvvirin sapvegyseh vgnkttirmt ypegaplsdl eyysndlfva 241 vlfksvdfnw lqamvkketl pfwvrlffwk qvaekiplqp khfrilnpvi iketafdilq 301 ysepqsrfwg rdknvptigv iavvlathlc devslagfgy dlnqprtplh yfdsqcmaam 361 nfqtmhnvtt etkfllklvk egvvkdlsgg idref
```

Lactosylceramide alpha-2,3-sialyltransferase, isoform 3
NP_001341152.1, NP_001341153.1, NP_001341155.1, NP_001341162.1,
NP_001341163.1, NP_001341177.1

(SEQ ID NO: 388)

```
  1 mallfehrys vdllpfvqka pkdseaesky dppfgfrkfs skvqtllell pehdlpehlk 61 aktcrrcvvi gsggilhgle lghtlnqfdv virinsapve gysehvgnkt tirmtypega 121 plsdleyysn dlfvavlfks vdfnwlqamv kketlpfwvr lffwkqvaek iplqpkhfri 181 lnpviiketa fdilqysepq srfwgrdknv ptigviavvl athlcdevsl agfgydlnqp 241 rtplhyfdsq cmaamnfqtm hnvttetkfl lklvkegvvk dlsggidref
```

Lactosylceramide alpha-2,3-sialyltransferase, isoform 4
NP_001341156.1, NP_001341158.1, NP_001341167.1

(SEQ ID NO: 389)

```
  1 mpseytyvkl rsdcsrpslq wytraqskmr rpslllkdil kctllvfgvw ilyilklnyt 61 teecdmkkmh yvdpdhvkra qkyaqqvlqk ecrpkfakts mallfehrys vdllpfvqka 121 pkdseaesky dppfgfrkfs skvqtllell pehdlpehlk aktcrrcvvi gsggilhgle 181 lghtlnqfdv virinsapve gysehvgnkt tirmtypega plsdleyysn dlfvavlfks 241 vdfnwlqamv kketlpfwvr lffwkqvaek iplqpkhfri lnpviiketa fdilqysepq 301 srfwgrdknv ptigviavvl athlcdevsl agfgydlnqp rtplhyfdsq cmaamnfqtm 361 hnvttetkfl lklvkegvvk dlsggidref
```

Lactosylceramide alpha-2,3-sialyltransferase, isoform 5
NP_001341176.1

(SEQ ID NO: 390)

```
  1 mtypegapls dleyysndlf vavlfksvdf nwlqamvkke tlpfwvrlff wkqvaekipl 61 qpkhfrilnp viiketafdi lgysepqsrf wgrdknvpti gviavvlath lcdevslagf 121 gydlnqprtp lhyfdsqcma amnfqtmhnv ttetkfllkl vkegvvkdls ggidref
```

Alpha-N-acetylneuraminide alpha-2,8-sialyltransferase, isoform 1
NP_003025.1

(SEQ ID NO: 391)

```
  1 mspcgrarrq tsrgamavla wkfprtrlpm gasalcvvvl cwlyifpvyr lpnekeivqg 61 vlqqgtawrr nqtaarafrk qmedccdpah lfamtkmnsp mgksmwydge flysftidns 121 tyslfpqatp fqlplkkcav vgnggilkks gcgrgidean fvmrcnlppl sseytkdvgs 181 ksqlvtanps iirqrfqnll wsrktfvdnm kiynhsyiym pafsmktgte pslrvyytls 241 dvganqtvlf anpnflrsig kfwksrgiha krlstglflv saalglceev aiygfwpfsv 301 nmheqpishh yydnvlpfsg fhampeeflq lwylhkigal rmqldpcedt slqpts
```

Alpha-N-acetylneuraminide alpha-2,8-sialyltransferase, isoform 2
NP_001291379.1
(SEQ ID NO: 392)

```
  1 mtgsfythsp ltiqltlssh rcnlpplsse ytkdvgsksq lvtanpsiir grfqnllwsr 61 ktfvdnmkiy nhsyiympaf smktgtepsl rvyytlsdvg angtvlfanp nflrsigkfw 121 ksrgihakrl stglflvsaa lglceevaiy gfwpfsvnmh eqpishhyyd nvlpfsgfha 181 mpeeflqlwy lhkigalrmq ldpcedtslq pts
```

Survivin, isoform 1 NP_001159.2
(SEQ ID NO: 393)

```
  1 mgaptlppaw qpflkdhris tfknwpfleg cactpermae agfihcpten epdlaqcffc 61 fkelegwepd ddpieehkkh ssgcaflsvk kqfeeltlge flkldrerak nkiaketnnk 121 kkefeetaek vrraieqlaa md
```

Survivin, isoform 2 NP_001012270.1
(SEQ ID NO: 394)

```
  1 mgaptlppaw qpflkdhris tfknwpfleg cactpermae agfihcpten epdlaqcffc 61 fkelegwepd ddpmqrkpti rrknlrkllr kcavpssswl pwieasgrsc lvpewlhhfq 121 glfpgatslp vgplams
```

Survivin, isoform 3 NP_001012271.1
(SEQ ID NO: 395)

```
  1 mgaptlppaw qpflkdhris tfknwpfleg cactpermae agfihcpten epdlaqcffc 61 fkelegwepd ddpigpgtva yacntstlgg rggritreeh kkhssgcafl svkkgfeelt 121 lgeflkldre raknkiaket nnkkkefeet aekvrraieq laamd
```

T-box 4, isoform 1 NP_001308049.1
(SEQ ID NO: 396)

```
  1 mlqdkglses eeafrapgpa lgeasaanap epalaapgls gaalgsppgp gadvvaaaaa 61 egtienikvg lhekelwkkf heagtemiit kagrrmfpsy kvkvtgmnpk tkyillidiv 121 paddhrykfc dnkwmvagka epampgrlyv hpdspatgah wmrqlvsfqk lkltnnhldp 181 fghiilnsmh kyqprlhivk adennafgsk ntafcthvfp etsfisvtsy qnhkitqlki 241 ennpfakgfr gsddsdlrva rlqskeypvi sksimrqrli spqlsatpdv gpllgthqal 301 qhyqhengah sqlaepqdlp lstfptqrds slfyhclkrr adgtrhldlp ckrsyleaps 361 svgedhyfrs pppydqqmls psycsevtpr eacmysgsgp eiagvsgvdd lppppplscnm 421 wtsyspytsy svqtmetvpy qpfpthftat tmmprlptls aqssqppgna hfsvynqlsq 481 sqvrergpsa sfprerglpq gcerkppsph lnaaneflys qtfslsress lqyhsgmgtv 541 enwtdg
```

T-box 4, isoform 2 NP_060958.2
(SEQ ID NO: 397)

```
  1 mlqdkglses eeafrapgpa lgeasaanap epalaapgls gaalgsppgp gadvvaaaaa 61 egtienikvg lhekelwkkf heagtemiit kagrrmfpsy kvkvtgmnpk tkyillidiv 121 paddhrykfc dnkwmvagka epampgrlyv hpdspatgah wmrqlvsfqk lkltnnhldp 181 fghiilnsmh kyqprlhivk adennafgsk ntafcthvfp etsfisvtsy qnhkitqlki 241 ennpfakgfr gsddsdlrva rlqskeypvi sksimrqrli spqlsatpdv gpllgthqal 301 qhyqhengah sqlaepqdlp lstfptqrds slfyhclkrr dgtrhldlpc krsyleapss 361 vgedhyfrsp ppydqqmlsp sycsevtpre acmysgsgpe iagvsgvddl pppplscnmw 421 tsyspytsys vqtmetvpyq pfpthftatt mmprlptlsa qssqppgnah fsvynqlsgs 481 qvrergpsas fprerglpqg cerkppsphl naaneflysq tfslsressl qyhsgmgtve 541 nwtdg
```

-continued

Angiopoietin-1 receptor, isoform 1 NP_000450.2

(SEQ ID NO: 398)

```
   1 mdslaslvlc gvslllsgtv egamdlilin slplvsdaet sltciasgwr phepitigrd
  61 fealmnqhqd plevtqdvtr ewakkvvwkr ekaskingay fcegrvrgea irirtmkmrq
 121 qasflpatlt mtvdkgdnvn isfkkvlike edaviykngs fihsvprhev pdilevhlph
 181 aqpqdagvys aryiggnlft saftrlivrr ceaqkwgpec nhlctacmnn gvchedtgec
 241 icppgfmgrt cekacelhtf grtckercsg gegcksyvfc lpdpygcsca tgwkglqcne
 301 achpgfygpd cklrcscnng emcdrfqgcl cspgwqglqc eregiprmtp kivdlpdhie
 361 vnsgkfnpic kasgwplptn eemtivkpdg tvlhpkdfnh tdhfsvaift ihrilppdsg
 421 vwvcsvntva gmvekpfnis vkvlpkpina pnvidtghnf avinissepy fgdgpikskk
 481 llykpvnhye awqhiqvtne ivtlnylepr teyelcvqlv rrgeggeghp gpvrrfttas
 541 iglppprgln llpksqttln ltwqpifpss eddfyvever rsvqksdqqn ikvpgnitsv
 601 llnnlhpreq yvvrarvntk aggewsedlt awtlsdilpp qpenikisni thssaviswt
 661 ildgysissi tirykvqgkn edqhvdvkik natitqyqlk glepetayqv difaennigs
 721 snpafshelv tlpesqapad lgggkmllia ilgsagmtcl tvllafliil qlkranvqrr
 781 magafqnvre epavqfnsgt lalnrkvknn pdptiypvld wndikfqdvi gegnfgqvlk
 841 arikkdglrm daaikrmkey askddhrdfa gelevlcklg hhpniinllg acehrgylyl
 901 aieyaphgnl ldflrksrvl etdpafaian stastlssqq llhfaadvar gmdylsqkqf
 961 ihrdlaarni lvgenyvaki adfglsrgqe vyvkktmgrl pvrwmaiesl nysvyttnsd
1021 vwsygvllwe ivslggtpyc gmtcaelyek lpqgyrlekp lncddevydl mrqcwrekpy
1081 erpsfaqilv slnrmleerk tyvnttlyek ftyagidcsa eeaa
```

Angiopoietin-1 receptor, isoform 2 NP_001277006.1

(SEQ ID NO: 399)

```
   1 mdslaslvlc gvslllsgtv egamdlilin slplvsdaet sltciasgwr phepitigrd
  61 fealmnqhqd plevtqdvtr ewakkvvwkr ekaskingay fcegrvrgea irirtmkmrq
 121 qasflpatlt mtvdkgdnvn isfkkvlike edaviykngs fihsvprhev pdilevhlph
 181 aqpqdagvys aryiggnlft saftrlivrr ceaqkwgpec nhlctacmnn gvchedtgec
 241 icppgfmgrt cekacelhtf grtckercsg gegcksyvfc lpdpygcsca tgwkglqcne
 301 giprmtpkiv dlpdhievns gkfnpickas gwplptneem tivkpdgtvl hpkdfnhtdh
 361 fsvaiftihr ilppdsgvwv csvntvagmv ekpfnisvkv lpkpinapnv idtghnfavi
 421 nissepyfgd gpikskklly kpvnhyeawq hiqvtneivt lnyleprtey elcvqlvrrg
 481 eggeghpgpv rrfttasigl ppprglnllp ksqttlnitw qpifpssedd fyveverrsv
 541 qksdqqnikv pgnitsvlln nlhpregyvv rarvntkagg ewsedltawt lsdilppqpe
 601 nikisniths saviswtild gysissitir ykvqgknedq hvdvkiknat itqyqlkgle
 661 petayqvdif aennigssnp afshelvtlp esqapadlgg gkmlliailg sagmtcltvl
 721 lafliilqlk ranvqrrmaq afqnvreepa vqfnsgtlal nrkvknnpdp tiypvldwnd
 781 ikfqdvigeg nfgqvlkari kkdglrmdaa ikrmkeyask ddhrdfagel evlcklghhp
 841 niinllgace hrgylylaie yaphgnlldf lrksrvletd pafaiansta stlssqqllh
 901 faadvargmd ylsqkqfihr dlaarnilvg enyvakiadf glsrgqevyv kktmgrlpvr
 961 wmaieslnys vyttnsdvws ygvllweivs lggtpycgmt caelyeklpq gyrlekpinc
1021 ddevydlmrq cwrekpyerp sfaqilvsln rmleerktyv nttlyekfty agidcsaeea
1081 a
```

-continued

Angiopoietin-1 receptor, isoform 3 NP_001277007.1
(SEQ ID NO: 400)

```
  1 mdslaslvlc gvslllsasf lpatltmtvd kgdnvnisfk kvlikeedav iykngsfihs
 61 vprhevpdil evhlphaqpq dagvysaryi ggnlftsaft rlivrrceaq kwgpecnhlc
121 tacmnngvch edtgecicpp gfmgrtceka celhtfgrtc kercsgqegc ksyvfclpdp
181 ygcscatgwk glqcnegipr mtpkivdlpd hievnsgkfn pickasgwpl ptneemtivk
241 pdgtvlhpkd fnhtdhfsva iftihrilpp dsgvwvcsvn tvagmvekpf nisvkvlpkp
301 lnapnvidtg hnfaviniss epyfgdgpik skkllykpvn hyeawqhiqv tneivtlnyl
361 eprteyelcv qlvrrgegge ghpgpvrrft tasiglpppr glnllpksqt tlnitwqpif
421 psseddfyve verrsvqksd qgnikvpgnl tsvllnnlhp reqyvvrary ntkaqgewse
481 dltawtlsdi lppqpeniki snithssavi swtildgysi ssitirykvq gknedqhvdv
541 kiknatitqy qlkglepeta yqvdifaenn igssnpafsh elvtlpesqa padlgggkml
601 liailgsagm tcltvllafl iilqlkranv grrmagafqn reepavqfns gtlalnrkvk
661 nnpdptiypv ldwndikfqd vigegnfgqv lkarikkdgl rmdaaikrmk eyaskddhrd
721 fagelevlck lghhpniinl lgacehrgyl ylaieyaphg nlldflrksr vletdpafai
781 anstastlss qqllhfaadv argmdylsqk qfihrdlaar nilvgenyva kiadfglsrg
841 qevyvkktmg rlpvrwmaie slnysvyttn sdvwsygvll weivslggtp ycgmtcaely
901 eklpqgyrle kpincddevy dlmrqcwrek pyerpsfaqi lvslnrmlee rktyvnttly
961 ekftyagidc saeeaa
```

Telomerase reverse transcriptase, isoform 1 NP_937983.2
(SEQ ID NO: 401)

```
   1 mpraprcrav rsllrshyre vlplatfvrr lgpqgwrlvq rgdpaafral vagclvcvpw
  61 darpppaaps frqvsclkel varvlqrlce rgaknvlafg falldgargg ppeafttsvr
 121 sylpntvtda lrgsgawgll lrrvgddvlv hllarcalfv lvapscayqv cgpplyqlga
 181 atqarpppha sgprrrlgce rawnhsvrea gvplglpapg arrrggsasr slplpkrprr
 241 gaapepertp vgqgswahpg rtrgpsdrgf cvvsparpae eatslegals gtrhshpsvg
 301 rqhhagppst srpprpwdtp cppvyaetkh flyssgdkeq lrpsfllssl rpsltgarrl
 361 vetiflgsrp wmpgtprrlp rlpqrywqmr plflellgnh aqcpygvllk thcplraavt
 421 paagvcarek pqgsvaapee edtdprrlvq llrghsspwq vygfvraclr rlvppglwgs
 481 rhnerrflrn tkkfislgkh aklslqeltw kmsvrdcawl rrspgvgcvp aaehrlreei
 541 lakflhwlms vyvvellrsf fyvtettfqk nrlffyrksv wsklqsigir ghlkrvglre
 601 lseaevrqhr earpallltsr lrfipkpdgl rpivnmdyvv gartfrrekr aerltsrvka
 661 lfsvinyera rrpgllgasv lglddihraw rtfvlrvraq dpppelyfvk vdvtgaydti
 721 pqdrltevia siikpqntyc vrryavvqka ahghvrkafk shvstltdlq pymrqfvahl
 781 getsplrdav viegssslne assglfdvfl rfmchhavri rgksyvqcqg ipqgsilstl
 841 lcslcygdme nklfagirrd glllrlvddf llvtphltha ktflrtivrg vpeygcvvnl
 901 rktvvnfpve dealggtafv qmpahglfpw cgllldtrtl evqsdyssya rtsirasltf
 961 nrgfkagrnm rrklfgvlrl kchslfldlq vnslqtvctn iykilllqay rfhacvlqlp
1021 fhqqvwknpt fflrvisdta slcysilkak nagmslgakg aagplpseav qwlchgafll
1081 kltrhrvtyv pllgslrtaq tqlsrklpgt tltaleaaan palpsdfkti ld
```

Telomerase reverse transcriptase, isoform 2 NP_001180305.1
(SEQ ID NO: 402)

```
  1 mpraprcrav rsllrshyre vlplatfvrr lgpqgwrlvq rgdpaafral vagclvcvpw
 61 darpppaaps frqvsclkel varvlqrlce rgaknvlafg falldgargg ppeafttsvr
```

-continued

```
 121 sylpntvtda lrgsgawgll lrrvgddvlv hllarcalfv lvapscayqv cgpplyqlga
 181 atqarpppha sgprrrlgce rawnhsvrea gvplglpapg arrrggsasr slplpkrprr
 241 gaapepertp vgqgswahpg rtrgpsdrgf cvvsparpae eatslegals gtrhshpsvg
 301 rqhhagppst srpprpwdtp cppvyaetkh flyssgdkeq lrpsfllssl rpsltgarrl
 361 vetiflgsrp wmpgtprrlp rlpqrywqmr plflellgnh aqcpygvllk thcplraavt
 421 paagvcarek pqgsvaapee edtdprrlvq llrghsspwq vygfvraclr rlvppglwgs
 481 rhnerrflrn tkkfislgkh aklslqeltw kmsvrdcawl rrspgvgcvp aaehrlreei
 541 lakflhwlms vyvvellrsf fyvtettfqk nrlffyrksv wsklqsigir ghlkrvglre
 601 lseaevrqhr earpalltsr lrfipkpdgl rpivnmdyvv gartfrrekr aerltsrvka
 661 lfsvinyera rrpgllgasv lglddihraw rtfvlrvraq dpppelyfvk vdvtgaydti
 721 pqdrltevia siikpqntyc vrryavvqka ahghvrkafk shvstltdlq pymrqfvahl
 781 getsplrdav viegssslne assglfdvfl rfmchhavri rgksyvqcqg ipqgsilstl
 841 lcslcygdme nklfagirrd glllrlvddf llvtphltha ktflsyarts irasltfnrg
 901 fkagrnmrrk lfgvlrlkch slfldlqvns lgtvctniyk illlqayrfh acvlqlpfhq
 961 qvwknptffl rvisdtaslc ysilkaknag mslgakgaag plpseavqwl chqafllklt
1021 rhrvtyvpll gslrtaqtql srklpgttlt aleaaanpal psdfktild
```

Cellular tumor antigen p53, isoform a NP_000537.3, NP_001119584.1
(SEQ ID NO: 403)

```
   1 meepqsdpsv epplsgetfs dlwkllpenn vlsplpsqam ddlmlspddi eqwftedpgp
  61 deaprmpeaa ppvapapaap tpaapapaps wplsssvpsq ktyggsygfr lgflhsgtak
 121 svtctyspal nkmfcqlakt cpvqlwvdst pppgtrvram aiykqsqhmt evvrrcphhe
 181 rcsdsdglap pqhlirvegn lrveylddrn tfrhsvvvpy eppevgsdct tihynymcns
 241 scmggmnrrp iltiitleds sgnllgrnsf evrvcacpgr drrteeenlr kkgephhelp
 301 pgstkralpn ntssspqpkk kpldgeyftl qirgrerfem frelnealel kdagagkepg
 361 gsrahsshlk skkgqstsrh kklmfkteg pdsd
```

Cellular tumor antigen p53, isoform b NP_001119586.1
(SEQ ID NO: 404)

```
   1 meepqsdpsv epplsgetfs dlwkllpenn vlsplpsqam ddlmlspddi eqwftedpgp
  61 deaprmpeaa ppvapapaap tpaapapaps wplsssvpsq ktyggsygfr lgflhsgtak
 121 svtctyspal nkmfcqlakt cpvqlwvdst pppgtrvram aiykqsqhmt evvrrcphhe
 181 rcsdsdglap pqhlirvegn lrveylddrn tfrhsvvvpy eppevgsdct tihynymcns
 241 scmggmnrrp iltiitleds sgnllgrnsf evrvcacpgr drrteeenlr kkgephhelp
 301 pgstkralpn ntssspqpkk kpldgeyftl qdqtsfqken c
```

Cellular tumor antigen p53, isoform c NP_001119585.1
(SEQ ID NO: 405)

```
   1 meepqsdpsv epplsgetfs dlwkllpenn vlsplpsqam ddlmlspddi eqwftedpgp
  61 deaprmpeaa ppvapapaap tpaapapaps wplsssvpsq ktyqgsygfr lgflhsgtak
 121 svtctyspal nkmfcglakt cpvqlwvdst pppgtrvram aiykqsqhmt evvrrcphhe
 181 rcsdsdglap pqhlirvegn lrveylddrn tfrhsvvvpy eppevgsdct tihynymcns
 241 scmggmnrrp iltiitleds sgnllgrnsf evrvcacpgr drrteeenlr kkgephhelp
 301 pgstkralpn ntssspqpkk kpldgeyftl qmlldlrwcy flinss
```

Cellular tumor antigen p53, isoform d NP_001119587.1
(SEQ ID NO: 406)

```
   1 mfcglaktcp vqlwvdstpp pgtrvramai ykqsqhmtev vrrcphherc sdsdglappq
```

```
 61 hlirvegnlr veylddrntf rhsvvvpyep pevgsdctti hynymcnssc mggmnrrpil 121 tiitledssg nllgrnsfev rvcacpgrdr rteeenlrkk gephhelppg stkralpnnt 181 ssspqpkkkp ldgeyftlqi rgrerfemfr elnealelkd aqagkepggs rahsshlksk 241 kgqstsrhkk lmfktegpds d
Cellular tumor antigen p53, isoform e NP_001119588.1
                                                          (SEQ ID NO: 407)
  1 mfcglaktcp vqlwvdstpp pgtrvramai ykqsqhmtev vrrcphherc sdsdglappq 61 hlirvegnlr veylddrntf rhsvvvpyep pevgsdctti hynymcnssc mggmnrrpil 121 tiitledssg nllgrnsfev rvcacpgrdr rteeenlrkk gephhelppg stkralpnnt 181 ssspqpkkkp ldgeyftlqd qtsfqkenc
Cellular tumor antigen p53, isoform f NP_001119589.1
                                                          (SEQ ID NO: 408)
  1 mfcglaktcp vqlwvdstpp pgtrvramai ykqsqhmtev vrrcphherc sdsdglappq 61 hlirvegnlr veylddrntf rhsvvvpyep pevgsdctti hynymcnssc mggmnrrpil 121 tiitledssg nllgrnsfev rvcacpgrdr rteeenlrkk gephhelppg stkralpnnt 181 ssspqpkkkp ldgeyftlqm lldlrwcyfl inss
Cellular tumor antigen p53, isoform g NP_001119590.1,
NP_001263689.1, NP_001263690.1
                                                          (SEQ ID NO: 409)
  1 mddlmlspdd ieqwftedpg pdeaprmpea appvapapaa ptpaapapap swplsssvps 61 qktyggsygf rlgflhsgta ksvtctyspa lnkmfcglak tcpvqlwvds tpppgtrvra 121 maiykqsqhm tevvrrcphh ercsdsdgla ppqhlirveg nlrveylddr ntfrhsvvvp 181 yeppevgsdc ttihynymcn sscmggmnrr piltiitled ssgnllgrns fevrvcacpg 241 rdrrteeenl rkkgephhel ppgstkralp nntssspqpk kkpldgeyft lqirgrerfe 301 mfrelneale lkdaqagkep ggsrahsshl kskkgqstsr hkklmfkteg pdsd
Cellular tumor antigen p53, isoform h NP_001263624.1
                                                          (SEQ ID NO: 410)
  1 mddlmlspdd ieqwftedpg pdeaprmpea appvapapaa ptpaapapap swplsssvps 61 qktyggsygf rlgflhsgta ksvtctyspa lnkmfcglak tcpvqlwvds tpppgtrvra 121 maiykqsqhm tevvrrcphh ercsdsdgla ppqhlirveg nlrveylddr ntfrhsvvvp 181 yeppevgsdc ttihynymcn sscmggmnrr piltiitled ssgnllgrns fevrvcacpg 241 rdrrteeenl rkkgephhel ppgstkralp nntssspqpk kkpldgeyft lqmlldlrwc 301 yflinss
Cellular tumor antigen p53, isoform i NP_001263625.1
                                                          (SEQ ID NO: 411)
  1 mddlmlspdd ieqwftedpg pdeaprmpea appvapapaa ptpaapapap swplsssvps 61 qktyggsygf rlgflhsgta ksvtctyspa lnkmfcglak tcpvqlwvds tpppgtrvra 121 maiykqsqhm tevvrrcphh ercsdsdgla ppqhlirveg nlrveylddr ntfrhsvvvp 181 yeppevgsdc ttihynymcn sscmggmnrr piltiitled ssgnllgrns fevrvcacpg 241 rdrrteeenl rkkgephhel ppgstkralp nntssspqpk kkpldgeyft lqdqtsfqke 301 nc
Cellular tumor antigen p53, isoform j NP_001263626.1
                                                          (SEQ ID NO: 412)
  1 maiykqsqhm tevvrrcphh ercsdsdgla ppqhlirveg nlrveylddr ntfrhsvvvp 61 yeppevgsdc ttihynymcn sscmggmnrr piltiitled ssgnllgrns fevrvcacpg 121 rdrrteeenl rkkgephhel ppgstkralp nntssspqpk kkpldgeyft lqirgrerfe 181 mfrelneale lkdaqagkep ggsrahsshl kskkgqstsr hkklmfkteg pdsd
```

-continued

Cellular tumor antigen p53, isoform k NP_001263627.1
(SEQ ID NO: 413)
```
  1 maiykqsqhm tevvrrcphh ercsdsdgla ppqhlirveg nlrveylddr ntfrhsvvvp
 61 yeppevgsdc ttihynymcn sscmggmnrr piltiitled ssgnllgrns fevrvcacpg
121 rdrrteeenl rkkgephhel ppgstkralp nntssspqpk kkpldgeyft lqdqtsfqke
181 nc
```

Cellular tumor antigen p53, isoform l NP_001263628.1
(SEQ ID NO: 414)
```
  1 maiykqsqhm tevvrrcphh ercsdsdgla ppqhlirveg nlrveylddr ntfrhsvvvp
 61 yeppevgsdc ttihynymcn sscmggmnrr piltiitled ssgnllgrns fevrvcacpg
121 rdrrteeenl rkkgephhel ppgstkralp nntssspqpk kkpldgeyft lqmlldlrwc
181 yflinss
```

Dopachrome tautomerase, isoform 1 NP_001913.2
(SEQ ID NO: 415)
```
  1 msplwwgfll sclgckilpg aqgqfprvcm tvdslvnkec cprlgaesan vcgsqqgrgq
 61 ctevradtrp wsgpyilrnq ddrelwprkf fhrtckctgn fagyncgdck fgwtgpncer
121 kkppvirgni hslspgereq flgaldlakk rvhpdyvitt qhwlgllgpn gtqpqfancs
181 vydffvwlhy ysvrdtllgp grpyraidfs hqgpafvtwh ryhllclerd lqrlignesf
241 alpywnfatg rnecdvctdq lfgaarpddp tlisrnsrfs swetvcdsld dynhlvticn
301 gtyegllrrn qmgrnsmklp tlkdirdcls lqkfdnppff qnstfsfrna legfdkadgt
361 ldsqvmslhn lvhsflngtn alphsaandp ifvvlhsftd aifdewmkrf nppadawpqe
421 lapighnrmy nmvpffppvt neelfltsdq lgysyaidlp vsveetpgwp ttllvvmgtl
481 valvglfvll aflqyrrlrk gytplmethl sskryteea
```

Dopachrome tautomerase, isoform 2 NP_001123361.1
(SEQ ID NO: 416)
```
  1 msplwwgfll sclgckilpg aqgqfprvcm tvdslvnkec cprlgaesan vcgsqqgrgq
 61 ctevradtrp wsgpyilrnq ddrelwprkf fhrtckctgn fagyncgdck fgwtgpncer
121 kkppvirgni hslspgereq flgaldlakk rvhpdyvitt qhwlgllgpn gtqpqfancs
181 vydffvwlhy ysvrdtllgp grpyraidfs hqgpafvtwh ryhllclerd lqrlignesf
241 alpywnfatg rnecdvctdq lfgaarpddp tlisrnsrfs swetvcdsld dynhlvticn
301 gtyegllrrn qmgrnsmklp tlkdirdcls lqkfdnppff qnstfsfrna legfdkadgt
361 ldsqvmslhn lvhsflngtn alphsaandp ifvvisnrll ynattnileh vrkekatkel
421 pslhvlvlhs ftdaifdewm krfnppadaw pgelapighn rmynmvpffp pvtneelflt
481 sdqlgysyai dlpvsveetp gwpttllvvm gtivalvglf vllaflqyrr lrkgytplme
541 thlsskryte ea
```

Dopachrome tautomerase, isoform 3 NP_001309111.1, NP_001309112.1, NP_001309113.1, NP_001309114.1
(SEQ ID NO: 417)
```
  1 mgrnsmklpt lkdirdclsl qkfdnppffq nstfsfrnal egfdkadgtl dsqvmslhnl
 61 vhsflngtna lphsaandpi fvvlhsftda ifdewmkrfn ppadawpgel apighnrmyn
121 mvpffppvtn eelfltsdql gysyaidlpv sveetpgwpt tllvvmgtiv alvglfvlla
181 flqyrrlrkg ytplmethls skryteea
```

Dopachrome tautomerase, isoform 4, NP_001309115.1
(SEQ ID NO: 418)
```
  1 mllgiqrqmk crlrsdvtkr leedehvnth spmrrgnfag yncgdckfgw tgpncerkkp
 61 pvirgnihsl spgeregflg aldlakkrvh pdyvittqhw lgllgpngtq pqfancsvyd
121 ffvwlhyysv rdtllgpgrp yraidfshqg pafvtwhryh llclerdlqr lignesfalp
```

```
181 ywnfatgrne cdvctdqlfg aarpddptli srnsrfsswe tvcdslddyn hlvticngty 241 egllrrnqmg rnsmklptlk dirdclslqk fdnppffqns tfsfrnaleg fdkadgtlds 301 qvmslhnlvh sflngtnalp hsaandpifv vlhsftdaif dewmkrfnpp adawpgelap 361 ighnrmynmv pffppvtnee lfltsdqlgy syaidlpvsv eetpgwpttl lvvmgtival 421 vglfvllafl qyrrlrkgyt plmethlssk ryteea
```

Transformation/transcription domain associated protein, isoform 1
NP_001231509.1

(SEQ ID NO: 419)

```
   1 mafvatqgat vvdqttlmkk ylqfvaaltd vntpdetklk mmqevsenfe nvtsspqyst 61 flehiiprfl tflqdgevqf lgekpaqqlr klvleiihri ptnehlrpht knvlsvmfrf 121 leteneenvl iclriiielh kgfrppitge ihhfldfvkq iykelpkvvn ryfenpqvip 181 entvpppemv gmittiavkv nperedsetr thsiiprgsl slkvlaelpi ivvlmyglyk 241 lnihnvvaef vplimntiai qvsagarghk lynkelyadf iaaqiktlsf layiiriyqe 301 lvtkysqqmv kgmlqllsnc paetahlrke lliaakhilt telrngfipc mdklfdesil 361 igsgytaret lrplaystla dlvhhvrghl plsdlslavq lfakniddes lpssiqtmsc 421 klllnlvdci rskseqesgn grdvlmrmle vfvlkfhtia ryqlsaifkk ckpqselgav 481 eaalpgvpta paapgpapsp apvpappppp ppppppatpvt papvppfekq gekdkedkqt 541 fqvtdcrslv ktivcgvkti twgitsckap geagfipnkg lqpketqiyi klvkyamgal 601 diyqvqiagn gqtyirvanc qtvrmkeeke vlehfagvft mmnpltfkei fqttvpymve 661 risknyalqi vansflanpt tsalfatilv eylldrlpem gsnvelsnly lklfklvfgs 721 vslfaaeneq mlkphlhkiv nssmelaqta kepynyflll ralfrsiggg shdllygefl 781 pllpnllqgl nmlgsglhkg hmkdlfvelc ltvpvrlssl lpylpmldmp lvsalngsqt 841 lvsqglrtle lcvdnlqpdf lydhiqpvra elmgalwrtl rnpadsishv ayrvlgkfgg 901 snrkmlkesq klhyvvtevq gpsitvefsd ckaslqlpme kaietaldcl ksantepyyr 961 rgawevikcf lvammsledn khalyqllah pnftektipn viishrykaq dtparktfeq 1021 altgafmsav ikdlrpsalp fvaslirhyt mvavaqqcgp fllpcyqvgs qpstamfhse 1081 engskgmdpl vlidaiaicm ayeekelcki gevalavifd vasiilgske racqlplfsy 1141 iverlcaccy eqawyaklgg vvsikflmer lpltwvlqnq qtflkallfv mmdltgevsn 1201 gavamakttl eqllmrcatp lkdeeraeei vaaqeksfhh vthdlvrevt spnstvrkqa 1261 mhslqvlaqv tgksvtvime phkevlqdmv ppkkhllrhq panaqiglme gntfcttlqp 1321 rlftmdlnvv ehkvfytell nlceaedsal tklpcykslp slvplriaal nalaacnylp 1381 qsrekiiaal fkalnstnse lqeageacmr kflegatiev dqihthmrpl lmmlgdyrsl 1441 tlnvvnrlts vtrlfpnsfn dkfcqgmmqh lrkwmevvvi thkggqrsdg nesisecgrc 1501 plspfcgfee mkicsaiinl fhlipaapqt lvkpllevvm kteramliea gspfreplik 1561 fltrhpsqtv elfmmeatln dpqwsrmfms flkhkdarpl rdvlaanpnr fitlllpgga 1621 qtavrpgsps tstmrldlqf qaikiisiiv knddswlasq hslvsqlrry wvsenfqerh 1681 rkenmaatnw kepkllaycl lnyckrnygd iellfqllra ftgrflcnmt flkeymeeei 1741 pknysiaqkr alffrfvdfn dpnfgdelka kvlqhilnpa flysfekgeg eqllgppnpe 1801 gdnpesitsv fitkvldpek qadmldslri yllqyatllv ehaphhihdn nknrnsklrr 1861 lmtfawpcll skacvdpack ysghllllahi iakfaihkki vlqvfhsllk ahamearaiv 1921 rqamailtpa vparmedghq mlthwtrkii veeghtvpql vhilhlivqh fkvyypvrhh 1981 lvqhmvsamq rlgftpsvti eqrrlavdls evvikwelqr ikdqqpdsdm dpnssgegvn
```

-continued

```
2041 sysssikrgl svdsagevkr frtatgaisa vfgrsgslpg adsllakpid kqhtdtvvnf 2101 lirvacqvnd ntntagspge vlsrrcvnll ktalrpdmwp kselklqwfd kllmtveqpn 2161 qvnygnictg levlsflltv lqspailssf kplqrgiaac mtcgntkvlr avhsllsrlm 2221 sifptepsts svaskyeele clyaavgkvi yegltnyeka tnanpsqlfg tlmilksacs 2281 nnpsyidrli svfmrslqkm vrehlnpqaa sgsteatsgt selvmlslel vktrlavmsm 2341 emrknfigai ltsliekspd akilravvki veewvknnsp maanqtptlr eksillvkmm 2401 tyiekrfped lelnagfldl vnyvyrdetl sgseltakle paflsglrca qplirakffe 2461 vfdnsmkrry yerllyvtcs qnweamgnhf wikqcielll avcekstpig tscqgamlps 2521 itnvinlads hdraafamvt hvkqeprere nseskeedve idielapgdq tstpktkels 2581 ekdignqlhm ltnrhdkfld tlrevktgal lsafvqlchi sttlaektwv qlfprlwkil 2641 sdrqqhalag eispflcsgs hqvgrdcqps alncfveams qcvppipirp cvlkylgkth 2701 nlwfrstlml ehqafekgls lqikpkqtte fyeqesitpp qqeildslae lysllqeedm 2761 waglwqkrck ysetataiay eqhgffeqaq esyekamdka kkehersnas paifpeyqlw 2821 edhwircske lnqwealtey gqskghinpy lvlecawrvs nwtamkealv qvevscpkem 2881 awkvnmyrgy laichpeeqq lsfierlvem asslairewr rlphvvshvh tpllgaagqi 2941 ielgeaaqin aglqptnlgr nnslhdmktv vktwrnrlpi vsddlshwss ifmwrqhhyq 3001 gkptwsgmhs ssivtayens sqhdpssnna mlgvhasasa iiqygkiark qglvnvaldi 3061 lsrihtiptv pivdcfqkir qqvkcylgla gvmgknecmq gleviestnl kyftkemtae 3121 fyalkgmfla qinkseeank afsaavqmhd vlvkawamwg dylenifvke rqlhlgvsai 3181 tcylhacrhq nesksrkyla kvlwllsfdd dkntladavd kycigvppiq wlawipqllt 3241 clvgsegkll lnlisqvgry ypqavyfpir tlyltlkieq reryksdpgp iratapmwrc 3301 srimhmgrel hptllssleg ivdqmvwfre nwheevlrql qqglakcysv afeksgaysd 3361 akitphtlnf vkklvstfgv glenvsnvst mfssaasesl arraqataqd pvfqklkgqf 3421 ttdfdfsvpg smklhnlisk lkkwikilea ktkqlpkffl ieekcrflsn fsaqtaevei 3481 pgeflmpkpt hyyikiarfm prveivqkhn taarrlyirg hngkiypylv mndacltesr 3541 reervlqllr llnpclekrk ettkrhlfft vprvvayspq mrlvednpss lslveiykqr 3601 cakkgiehdn pisryydrla tvgargtgas hqvlrdilke vqsnmvprsm lkewalhtfp 3661 natdywtfrk mftiqlalig faefvlhlnr lnpemlqiaq dtgklnvayf rfdindatgd 3721 ldanrpvpfr ltpniseflt tigvsgplta smiavarcfa qpnfkvdgil ktvlrdeiia 3781 whkktqedts splsaagqpe nmdsqqlvsl vqkavtaimt rlhnlaqfeg geskvntiva 3841 aansldnlcr mdpawhpwl
```

Transformation/transcription domain associated protein, isoform 2
NP_003487.1

(SEQ ID NO: 420)

```
  1 mafvatqgat vvdqttlmkk ylqfvaaltd vntpdetklk mmqevsenfe nvtsspqyst 61 flehiiprfl tflqdgevqf lgekpaqqlr klvleiihri ptnehlrpht knvlsvmfrf 121 leteneenvl iclriiielh kgfrppitge ihhfldfvkq iykelpkvvn ryfenpqvip 181 entvpppemv gmittiavkv nperedsetr thsiiprgsl slkvlaelpi ivvlmyglyk 241 lnihnvvaef vplimntiai qvsagarghk lynkelyadf iaaqiktlsf layiiriyqe 301 lvtkysqqmv kgmlqllsnc paetahlrke lliaakhilt telrngfipc mdklfdesil 361 igsgytaret lrplaystla dlvhhvrghl plsdlslavq lfaknidles lpssiqtmsc 421 klllnlvdci rskseqesgn grdvlmrmle vfvlkfhtia ryqlsaifkk ckpqselgav
```

-continued

```
 481 eaalpgvpta paapgpapsp apvpappppp pppppatpvt papvppfekq gekdkedkqt 541 fqvtdcrslv ktivcgvkti twgitsckap geagfipnkg lqpketqiyi klvkyamgal 601 diyqvqiagn gqtyirvanc qtvrmkeeke vlehfagvft mmnpltfkei fqttvpymve 661 risknyalqi vansflanpt tsalfatilv eylldrlpem gsnvelsnly lklfklvfgs 721 vslfaaeneq mlkphlhkiv nssmelaqta kepynyflll ralfrsiggg shdllygefl 781 pllpnllqgl nmlgsglhkg hmkdlfvelc ltvpvrlssl lpylpmlmdp lvsalngsqt 841 lvsqglrtle lcvdnlqpdf lydhiqpvra elmgalwrtl rnpadsishv ayrvlgkfgg 901 snrkmlkesq klhyvvtevq gpsitvefsd ckaslqlpme kaietaldcl ksantepyyr 961 rgawevikcf lvammsledn khalyqllah pnftektipn viishrykaq dtparktfeq 1021 altgafmsav ikdlrpsalp fvaslirhyt mvavaqqcgp fllpcyqvgs qpstamfhse 1081 engskgmdpl vlidaiaicm ayeekelcki gevalavifd vasiilgske racqlplfsy 1141 iverlcaccy eqawyaklgg vvsikflmer lpltwvlqnq qtflkallfv mmdltgevsn 1201 gavamakttl eqllmrcatp lkdeeraeei vaaqeksfhh vthdlvrevt spnstvrkqa 1261 mhslqvlaqv tgksvtvime phkevlqdmv ppkkhllrhq panaqiglme gntfcttlqp 1321 rlftmdlnvv ehkvfytell nlceaedsal tklpcykslp slvplriaal nalaacnylp 1381 qsrekiiaal fkalnstnse lqeageacmr kflegatiev dqihthmrpl lmmlgdyrsl 1441 tlnvvnrlts vtrlfpnsfn dkfcqgmmqh lrkwmevvvi thkggqrsdg nemkicsaii 1501 nlfhlipaap qtivkpllev vmkteramli eagspfrepl ikfltrhpsq tvelfmmeat 1561 lndpqwsrmf msflkhkdar plrdvlaanp nrfitlllpg gaqtavrpgs pststmrldl 1621 qfgaikiisi ivknddswla sqhslvsqlr rvwvsenfqe rhrkenmaat nwkepkllay 1681 cllnyckrny gdiellfqll raftgrflcn mtflkeymee eipknysiaq kralffrfvd 1741 fndpnfgdel kakvlqhiln paflysfekg egegllgppn pegdnpesit svfitkvldp 1801 ekqadmldsl riyllqyatl lvehaphhih dnnknrnskl rrlmtfawpc llskacvdpa 1861 ckysghllla hiiakfaihk kivlqvfhsl lkahameara ivrqamailt pavparmedg 1921 hqmlthwtrk iiveeghtvp qlvhilhliv qhfkvyypvr hhlvqhmvsa mgrlgftpsv 1981 tieqrrlavd lsevvikwel grikdqqpds dmdpnssgeg vnsysssikr glsvdsagev 2041 krfrtatgai savfgrsqsl pgadsllakp idkqhtdtvv nflirvacqv ndntntagsp 2101 gevlsrrcvn llktalrpdm wpkselklqw fdkllmtveq pnqvnygnic tglevlsfll 2161 tvlqspails sfkplqrgia acmtcgntkv lravhsllsr lmsifpteps tssvaskyee 2221 leclyaavgk viyegltnye katnanpsql fgtlmilksa csnnpsyidr lisvfmrslq 2281 kmvrehlnpq aasgsteats gtselvmlsl elvktrlavm smemrknfiq ailtslieks 2341 pdakilravv kiveewvknn spmaanqtpt lreksillvk mmtyiekrfp edlelnagfl 2401 dlvnyvyrde tlsgseltak lepaflsglr caqpliakf fevfdnsmkr rvyerllyvt 2461 csqnweamgn hfwikqciel llavcekstp igtscqgaml psitnvinla dshdraafam 2521 vthvkqepre renseskeed veidielapg dqtstpktke lsekdignql hmltnrhdkf 2581 ldtlrevktg allsafvqlc histtlaekt wvqlfprlwk ilsdrqqhal ageispflcs 2641 gshqvqrdcq psalncfvea msqcvppipi rpcvlkylgk thnlwfrstl mlehqafekg 2701 lslqikpkqt tefyeqesit ppggeildsl aelysllqee dmwaglqwkr ckysetatai 2761 ayeqhgffeq aqesyekamd kakkehersn aspaifpeyq lwedhwircs kelnqwealt 2821 eygqskghin pylvlecawr vsnwtamkea lvqvevscpk emawkvnmyr gylaichpee 2881 qqlsfierlv emasslaire wrrlphvvsh vhtpllqaaq qiielgeaaq inaglqptnl
```

-continued

```
2941 grnnslhdmk tvvktwrnrl pivsddlshw ssifmwrqhh ygaivtayen ssqhdpssnn 3001 amlgvhasas aiiqygkiar kgglvnvald ilsrihtipt vpivdcfgki rggvkcylgl 3061 agvmgknecm qgleviestn lkyftkemta efyalkgmfl aqinkseean kafsaavqmh 3121 dvlvkawamw gdylenifvk erglhlgvsa itcylhacrh gnesksrkyl akvlwllsfd 3181 ddkntladav dkycigvppi gwlawipgll tclvgsegkl llnlisqvgr vypqavyfpi 3241 rtlyltlkie greryksdpg piratapmwr csrimhmgre lhptllssle givdqmvwfr 3301 enwheevlrq lggglakcys vafeksgays dakitphtln fvkklvstfg vglenvsnvs 3361 tmfssaases larragatag dpvfgklkgq fttdfdfsvp gsmklhnlis klkkwikile 3421 aktkqlpkff lieekcrfls nfsaqtaeve ipgeflmpkp thyyikiarf mprveivqkh 3481 ntaarrlyir ghngkiypyl vmndaclteS rreervlgll rllnpclekr kettkrhlff 3541 tvprvvaysp gmrlvednps slslveiykg rcakkgiehd npisryydrl atvgargtqa 3601 shgvlrdilk evqsnmvprs mlkewalhtf pnatdywtfr kmftiqlali gfaefvlhln 3661 rinpemlgia gdtgklnvay frfdindatg dldanrpvpf rltpnisefl ttigvsgplt 3721 asmiavarcf aqpnfkvdgi lktvlrdeii awhkktqedt ssplsaaggp enmdsgglys 3781 lvgkavtaim trlhnlagfe ggeskvntiv aaansldnlc rmdpawhpwl
```

Tyrosinase precursor NP_000363.1
(SEQ ID NO: 421)

```
  1 mllavlycll wsfqtsaghf pracvssknl mekeccppws gdrspcgqls grgscgnill 61 snaplgpqfp ftgvddresw psvfynrtcq csgnfmgfnc gnckfgfwgp ncterrllvr 121 rnifdlsape kdkffayltl akhtissdyv ipigtygqmk ngstpmfndi niydlfvwmh 181 yyvsmdallg gseiwrdidf aheapaflpw hrlfllrweg eigkltgden ftipywdwrd 241 aekcdictde ymggqhptnp nllspasffs swgivcsrle eynshqslcn gtpegplrrn 301 pgnhdksrtp rlpssadvef clsltgyesg smdkaanfsf rntlegfasp ltgiadasqs 361 smhnalhiym ngtmsqvggs andpifllhh afvdsifeqw lrrhrplgev ypeanapigh 421 nresymvpfi plyrngdffi sskdlgydys ylqdsdpdsf gdyiksyleg asriwswllg 481 aamvgavlta llaglvsllc rhkrkglpee kgpllmeked yhslygshl
```

Vascular endothelial growth factor A, isoform a NP_001020537.2
(SEQ ID NO: 422)

```
  1 mtdrqtdtap spsyhllpgr rrtvdaaasr gqgpepapgg gvegvgargv alklfvgllg 61 csrfggavvr ageaepsgaa rsassgreep gpeegeeeee keeergpqwr lgarkpgswt 121 geaavcadsa paarapgala rasgrggrva rrgaeesgpp hspsrrgsas ragpgraset 181 mnfllswvhw slalllylhh akwsgaapma egggqnhhev vkfmdvyqrs ychpietivd 241 ifqeypdeie yifkpscvpl mrcggccnde glecvptees nitmgimrik phqgghigem 301 sflqhnkcec rpkkdrarge kksvrgkgkg qkrkrkksry kswsvyvgar cclmpwslpg 361 phpcgpcser rkhlfvgdpg tckcsckntd srckarglel nertcrcdkp rr
```

Vascular endothelial growth factor A, isoform b NP_003367.4
(SEQ ID NO: 423)

```
  1 mtdrqtdtap spsyhllpgr rrtvdaaasr gqgpepapgg gvegvgargv alklfvgllg 61 csrfggavvr ageaepsgaa rsassgreep gpeegeeeee keeergpqwr lgarkpgswt 121 geaavcadsa paarapgala rasgrggrva rrgaeesgpp hspsrrgsas ragpgraset 181 mnfllswvhw slalllylhh akwsgaapma egggqnhhev vkfmdvyqrs ychpietivd
```

-continued

```
    241 ifqeypdeie yifkpscvpl mrcggccnde glecvptees nitmgimrik phqgghigem 301 sflqhnkcec rpkkdrarge kksvrgkgkg qkrkrkksry kswsvpcgpc serrkhlfvq 361 dpqtckcsck ntdsrckarq lelnertcrc dkprr
```

Vascular endothelial growth factor A, isoform c NP_001020538.2
(SEQ ID NO: 424)
```
      1 mtdrqtdtap spsyhllpgr rrtvdaaasr gqgpepapgg gvegvgargv alklfvqllg 61 csrfggavvr ageaepsgaa rsassgreep gpeegeeeee keeergpqwr lgarkpgswt 121 geaavcadsa paarapgala rasgrggrva rrgaeesgpp hspsrrgsas ragpgraset 181 mnfllswvhw slalllylhh akwsqaapma egggqnhhev vkfmdvyqrs ychpietivd 241 ifqeypdeie yifkpscvpl mrcggccnde glecvptees nitmgimrik phqgghigem 301 sflqhnkcec rpkkdrarge kksvrgkgkg qkrkrkksrp cgpcserrkh lfvgdpgtck 361 csckntdsrc karglelner tcrcdkprr
```

Vascular endothelial growth factor A, isoform d NP_001020539.2
(SEQ ID NO: 425)
```
      1 mtdrqtdtap spsyhllpgr rrtvdaaasr gqgpepapgg gvegvgargv alklfvqllg 61 csrfggavvr ageaepsgaa rsassgreep qpeegeeeee keeergpqwr lgarkpgswt 121 geaavcadsa paarapqala rasgrggrva rrgaeesgpp hspsrrgsas ragpgraset 181 mnfllswvhw slalllylhh akwsqaapma egggqnhhev vkfmdvyqrs ychpietivd 241 ifqeypdeie yifkpscvpl mrcggccnde glecvptees nitmqimrik phqgqhigem 301 sflqhnkcec rpkkdrarqe npcgpcserr khlfvgdpqt ckcsckntds rckarqleln 361 ertcrcdkpr r
```

Vascular endothelial growth factor A, isoform e NP_001020540.2
(SEQ ID NO: 426)
```
      1 mtdrqtdtap spsyhllpgr rrtvdaaasr gqgpepapgg gvegvgargv alklfvqllg 61 csrfggavvr ageaepsgaa rsassgreep qpeegeeeee keeergpqwr lgarkpgswt 121 geaavcadsa paarapqala rasgrggrva rrgaeesgpp hspsrrgsas ragpgraset 181 mnfllswvhw slalllylhh akwsqaapma egggqnhhev vkfmdvyqrs ychpietivd 241 ifqeypdeie yifkpscvpl mrcggccnde glecvptees nitmqimrik phqgqhigem 301 sflqhnkcec rpkkdrarqe npcgpcserr khlfvgdpqt ckcsckntds rckm
```

Vascular endothelial growth factor A, isoform f NP_001020541.2
(SEQ ID NO: 427)
```
      1 mtdrqtdtap spsyhllpgr rrtvdaaasr gqgpepapgg gvegvgargv alklfvqllg 61 csrfggavvr ageaepsgaa rsassgreep qpeegeeeee keeergpqwr lgarkpgswt 121 geaavcadsa paarapqala rasgrggrva rrgaeesgpp hspsrrgsas ragpgraset 181 mnfllswvhw slalllylhh akwsqaapma egggqnhhev vkfmdvyqrs ychpietivd 241 ifqeypdeie yifkpscvpl mrcggccnde glecvptees nitmqimrik phqgqhigem 301 sflqhnkcec rpkkdrarqe kcdkprr
```

Vascular endothelial growth factor A, isoform g NP_001028928.1
(SEQ ID NO: 428)
```
      1 mtdrqtdtap spsyhllpgr rrtvdaaasr gqgpepapgg gvegvgargv alklfvqllg 61 csrfggavvr ageaepsgaa rsassgreep qpeegeeeee keeergpqwr lgarkpgswt 121 geaavcadsa paarapqala rasgrggrva rrgaeesgpp hspsrrgsas ragpgraset 181 mnfllswvhw slalllylhh akwsqaapma egggqnhhev vkfmdvyqrs ychpietivd 241 ifqeypdeie yifkpscvpl mrcggccnde glecvptees nitmqimrik phqgqhigem
```

```
301 sflqhnkcec rpkkdrarqe npcgpcserr khlfvgdpqt ckcsckntds rckarqleln 361 ertcrsltrk d
```

Vascular endothelial growth factor A, isoform h NP_001165093.1
(SEQ ID NO: 429)
```
  1 mtdrqtdtap spsyhllpgr rrtvdaaasr gqgpepapgg gvegvgargv alklfvqllg 61 csrfggavvr ageaepsgaa rsassgreep qpeegeeeee keeergpqwr lgarkpgswt 121 geaavcadsa paarapqala rasgrggrva rrgaeesgpp hspsrrgsas ragpgraset 181 mnfllswvhw slalllylhh akwsqaapma egggqnhhev vkfmdvyqrs ychpietivd 241 ifqeypdeie yifkpscvpl mrcggccnde glecvptees nitmqimrik phqgqhigem 301 sflqhnkcec rcdkprr
```

Vascular endothelial growth factor A, isoform i NP_001165094.1
(SEQ ID NO: 430)
```
  1 mnfllswvhw slalllylhh akwsqaapma egggqnhhev vkfmdvyqrs ychpietivd 61 ifqeypdeie yifkpscvpl mrcggccnde glecvptees nitmqimrik phqgqhigem 121 sflqhnkcec rpkkdrarqe kksvrgkgkg qkrkrkksry kswsvyvgar cclmpwslpg 181 phpcgpcser rkhlfvqdpq tckcsckntd srckarglel nertcrcdkp rr
```

Vascular endothelial growth factor A, isoform j NP_001165095.1
(SEQ ID NO: 431)
```
  1 mnfllswvhw slalllylhh akwsqaapma egggqnhhev vkfmdvyqrs ychpietivd 61 ifqeypdeie yifkpscvpl mrcggccnde glecvptees nitmqimrik phqgqhigem 121 sflqhnkcec rpkkdrarqe kksvrgkgkg qkrkrkksry kswsvpcgpc serrkhlfvq 181 dpqtckcsck ntdsrckarq lelnertcrc dkprr
```

Vascular endothelial growth factor A, isoform k NP_001165096.1
(SEQ ID NO: 432)
```
  1 mnfllswvhw slalllylhh akwsqaapma egggqnhhev vkfmdvyqrs ychpietivd 61 ifqeypdeie yifkpscvpl mrcggccnde glecvptees nitmqimrik phqgqhigem 121 sflqhnkcec rpkkdrarqe kksvrgkgkg qkrkrkksrp cgpcserrkh lfvqdpqtck 181 cscknntdsrc karqlelner tcrcdkprr
```

Vascular endothelial growth factor A, isoform l NP_001165097.1
(SEQ ID NO: 433)
```
  1 mnfllswvhw slalllylhh akwsqaapma egggqnhhev vkfmdvyqrs ychpietivd 61 ifqeypdeie yifkpscvpl mrcggccnde glecvptees nitmqimrik phqgqhigem 121 sflqhnkcec rpkkdrarqe npcgpcserr khlfvgdpqt ckcsckntds rckarqleln 181 ertcrcdkpr r
```

Vascular endothelial growth factor A, isoform m NP_001165098.1
(SEQ ID NO: 434)
```
  1 mnfllswvhw slalllylhh akwsqaapma egggqnhhev vkfmdvyqrs ychpietivd 61 ifqeypdeie yifkpscvpl mrcggccnde glecvptees nitmqimrik phqgqhigem 121 sflqhnkcec rpkkdrarqe npcgpcserr khlfvgdpqt ckcsckntds rckm
```

Vascular endothelial growth factor A, isoform n NP_001165099.1
(SEQ ID NO: 435)
```
  1 mnfllswvhw slalllylhh akwsqaapma egggqnhhev vkfmdvyqrs ychpietivd 61 ifqeypdeie yifkpscvpl mrcggccnde glecvptees nitmqimrik phqgqhigem 121 sflqhnkcec rpkkdrarqe kcdkprr
```

Vascular endothelial growth factor A, isoform o NP_001165100.1
(SEQ ID NO: 436)
```
  1 mnfllswvhw slalllylhh akwsqaapma egggqnhhev vkfmdvyqrs ychpietivd 61 ifqeypdeie yifkpscvpl mrcggccnde glecvptees nitmqimrik phqgqhigem
```

-continued

```
121 sflqhnkcec rpkkdrarqe npcgpcserr khlfvgdpqt ckcsckntds rckarqleln 181 ertcrsltrk d
```

Vascular endothelial growth factor A, isoform p NP_001165101.1
(SEQ ID NO: 437)
```
  1 mnfllswvhw slalllylhh akwsqaapma egggqnhhev vkfmdvyqrs ychpietivd 61 ifqeypdeie yifkpscvpl mrcggccnde glecvptees nitmqimrik phqgqhigem 121 sflqhnkcec rcdkprr
```

Vascular endothelial growth factor A, isoform q NP_001191313.1
(SEQ ID NO: 438)
```
  1 mnfllswvhw slalllylhh akwsqaapma egggqnhhev vkfmdvyqrs ychpietivd 61 ifqeypdeie yifkpscvpl mrcggccnde glecvptees nitmqimrik phqgqhigem 121 sflqhnkcec rpkkdrarqe kksvrgkgkg qkrkrkksry kswsvcdkpr r
```

Vascular endothelial growth factor A, isoform r NP_001191314.1
(SEQ ID NO: 439)
```
  1 mtdrqtdtap spsyhllpgr rrtvdaaasr gqgpepapgg gvegvgargv alklfvqllg 61 csrfggavvr ageaepsgaa rsassgreep qpeegeeeee keeergpqwr lgarkpgswt 121 geaavcadsa paarapqala rasgrggrva rrgaeesgpp hspsrrgsas ragpgraset 181 mnfllswvhw slalllylhh akwsqaapma egggqnhhev vkfmdvyqrs ychpietivd 241 ifqeypdeie yifkpscvpl mrcggccnde glecvptees nitmqimrik phqgqhigem 301 sflqhnkcec rpkkdrarqe kksvrgkgkg qkrkrkksry kswsvcdkpr r
```

Vascular endothelial growth factor A, isoform s NP_001273973.1
(SEQ ID NO: 440)
```
  1 maegggqnhh evvkfmdvyq rsychpietl vdifqeypde ieyifkpscv plmrcggccn 61 deglecvpte esnitmqimr ikphqgqhig emsflqhnkc ecrpkkdrar genpcgpcse 121 rrkhlfvqdp qtckcscknt dsrckarqle lnertcrcdk prr
```

Vascular endothelial growth factor A, isoform VEGF-Ax precursor NP_001303939.1
(SEQ ID NO: 441)
```
  1 mnfllswvhw slalllylhh akwsqaapma egggqnhhev vkfmdvyqrs ychpietivd 61 ifqeypdeie yifkpscvpl mrcggccnde glecvptees nitmqimrik phqgqhigem 121 sflqhnkcec rpkkdrarqe npcgpcserr khlfvgdpqt ckcsckntds rckarqleln 181 ertcrcdkpr rsagqeegas lrvsgtrslt rkd
```

WD repeat-containing protein 46, isoform 1 NP_005443.3
(SEQ ID NO: 442)
```
  1 metapkpgkd vppkkdklqt krkkprrywe eetvpttaga spgpprnkkn relrpqrpkn 61 ayilkksris kkpqvpkkpr ewknpesqrg lsgtqdpfpg papvpvevvq kfcridksrk 121 lphskaktrs rlevaeaeee etsikaarse lllaeepgfl egedgedtak icqadiveav 181 diasaakhfd lnlrqfgpyr lnysrtgrhl afggrrghva aldwvtkklm ceinvmeavr 241 dirflhseal lavaqnrwlh iydnqgielh cirrcdrvtr leflpfhfll atasetgflt 301 yldvsvgkiv aalnaragrl dvmsqnpyna vihlghsngt vslwspamke plakilchrg 361 gvravavdst gtymatsgld hqlkifdlrg tyqplstrtl phgaghlafs qrgllvagmg 421 dvvniwagqg kasppsleqp ylthrlsgpv hglqfcpfed vlgvghtggi tsmlvpgage 481 pnfdglesnp yrsrkgrgew evkallekvp aelicldpra laevdvisle qgkkeqierl 541 gydpqakapf qpkpkqkgrs staslvkrkr kvmdeehrdk vrqslqqqhh keakakptga 601 rpsaldrfvr
```

WD repeat-containing protein 46, isoform 2 NP_001157739.1
(SEQ ID NO: 443)
```
  1 metapkpgkd vppkkdklqt krkkprewkn pesqrglsgt qdpfpgpapv pvevvqkfcr
```

```
  61 idksrklphs kaktrsrlev aeaeeeetsi kaarsellla eepgfleged gedtakicqa 121 diveavdias aakhfdlnlr qfgpyrinys rtgrhlafgg rrghvaaldw vtkklmcein 181 vmeavrdirf lhseallava qnrwlhiydn qgielhcirr cdrvtrlefl pfhfllatas 241 etgfltyldv svgkivaaln aragrldvms qnpynavihl ghsngtvslw spamkeplak 301 ilchrggvra vavdstgtym atsgldhqlk ifdlrgtyqp lstrtlphga ghlafsqrgl 361 lvagmgdvvn iwagqgkasp psleqpylth rlsgpvhglq fcpfedvlgv ghtggitsml 421 vpgagepnfd glesnpyrsr kgrgewevka llekvpaeli cldpralaev dvisleqgkk 481 eqierlgydp qakapfqpkp kqkgrsstas lvkrkrkvmd eehrdkvrqs lqqqhhkeak 541 akptgarpsa ldrfvr
```

Wilms tumor protein, isoform A NP_000369.4

(SEQ ID NO: 444)
```
   1 mdflllqdpa stcvpepasq htlrsgpgcl qqpeqqgvrd pggiwaklga aeasaerlqg 61 rrsrgasgse pqqmgsdvrd lnallpavps lggggggcalp vsgaaqwapv ldfappgasa 121 ygslggpapp papppppppp phsfikqeps wggaepheeq clsaftvhfs gqftgtagac 181 rygpfgpppp sgassggarm fpnapylpsc lesqpairnq gystvtfdgt psyghtpshh 241 aaqfpnhsfk hedpmgqqgs lgeggysvpp pvygchtptd sctgsgalll rtpyssdnly 301 qmtsqlecmt wnqmnlgatl kghstgyesd nhttpilcga qyrihthgvf rgiqdvrrvp 361 gvaptivrsa setsekrpfm caypgcnkry fklshlqmhs rkhtgekpyq cdfkdcerrf 421 srsdqlkrhq rrhtgvkpfq cktcqrkfsr sdhlkthtrt htgekpfscr wpscqkkfar 481 sdelvrhhnm hqrnmtklql al
```

Wilms tumor protein, isoform B NP_077742.3

(SEQ ID NO: 445)
```
   1 mdflllqdpa stcvpepasq htlrsgpgcl qqpeqqgvrd pggiwaklga aeasaerlqg 61 rrsrgasgse pqqmgsdvrd lnallpavps lggggggcalp vsgaaqwapv ldfappgasa 121 ygslggpapp papppppppp phsfikqeps wggaepheeq clsaftvhfs gqftgtagac 181 rygpfgpppp sgassggarm fpnapylpsc lesqpairnq gystvtfdgt psyghtpshh 241 aaqfpnhsfk hedpmgqqgs lgeggysvpp pvygchtptd sctgsgalll rtpyssdnly 301 qmtsqlecmt wnqmnlgatl kgvaagssss vkwtegqsnh stgyesdnht tpilcgagyr 361 ihthgvfrgi qdvrrvpgva ptivrsaset sekrpfmcay pgcnkryfkl shlqmhsrkh 421 tgekpyqcdf kdcerrfsrs dqlkrhgrrh tgvkpfqckt cqrkfsrsdh lkthtrthtg 481 ekpfscrwps cqkkfarsde lvrhhnmhqr nmtklglal
```

Wilms tumor protein, isoform D NP_077744.4

(SEQ ID NO: 446)
```
   1 mdflllqdpa stcvpepasq htlrsgpgcl qqpeqqgvrd pggiwaklga aeasaerlqg 61 rrsrgasgse pqqmgsdvrd lnallpavps lggggggcalp vsgaaqwapv ldfappgasa 121 ygslggpapp papppppppp phsfikqeps wggaepheeq clsaftvhfs gqftgtagac 181 rygpfgpppp sgassggarm fpnapylpsc lesqpairnq gystvtfdgt psyghtpshh 241 aaqfpnhsfk hedpmgqqgs lgeggysvpp pvygchtptd sctgsgalll rtpyssdnly 301 qmtsqlecmt wnqmnlgatl kgvaagssss vkwtegqsnh stgyesdnht tpilcgagyr 361 ihthgvfrgi qdvrrvpgva ptivrsaset sekrpfmcay pgcnkryfkl shlqmhsrkh 421 tgekpyqcdf kdcerrfsrs dqlkrhgrrh tgvkpfqckt cqrkfsrsdh lkthtrthtg 481 ktsekpfscr wpscqkkfar sdelvrhhnm hqrnmtklql al
```

Wilms tumor protein, isoform E NP_001185480.1

(SEQ ID NO: 447)
```
   1 mekgystvtf dgtpsyghtp shhaaqfpnh sfkhedpmgq ggslgeggys vpppvygcht
```

-continued

```
 61 ptdsctgsqa lllrtpyssd nlyqmtsqle cmtwnqmnlg atlkgvaags sssvkwtegq 121 snhstgyesd nhttpilcga qyrihthgvf rgiqdvrrvp gvaptivrsa setsekrpfm 181 caypgcnkry fklshlqmhs rkhtgekpyq cdfkdcerrf srsdqlkrhq rrhtgvkpfq 241 cktcqrkfsr sdhlkthtrt htgekpfscr wpscqkkfar sdelvrhhnm hqrnmtklql 301 al
```

Wilms tumor protein, isoform F NP_001185481.1
(SEQ ID NO: 448)
```
  1 mekgystvtf dgtpsyghtp shhaaqfpnh sfkhedpmgq ggslgeggys vpppvygcht 61 ptdsctgsqa lllrtpyssd nlyqmtsqle cmtwnqmnlg atlkghstgy esdnhttpil 121 cgaqyrihth gvfrgiqdvr rvpgvaptiv rsasetsekr pfmcaypgcn kryfklshlq 181 mhsrkhtgek pyqcdfkdce rrfsrsdqlk rhqrrhtgvk pfqcktcqrk fsrsdhlkth 241 trthtgktse kpfscrwpsc qkkfarsdel vrhhnmhqrn mtklglal
```

X antigen family member 1, isoform a NP_001091063.2
(SEQ ID NO: 449)
```
  1 mespkkknqq lkvgilhlgs rqkkiriqlr sqcatwkvic ksqsqtpgi nldlgsgvkv 61 kiipkeehck mpeageeqpq v
```

X antigen family member 1, isoform d NP_001091065.1
(SEQ ID NO: 450)
```
  1 mespkkknqq lkvgilhlgs rqkkiriqlr sqvlgremrd megdlgelhq sntgdksgfg 61 frrqgednt
```

X-linked inhibitor of apoptosis NP_001158.2, NP_001191330.1
(SEQ ID NO: 451)
```
  1 mtfnsfegsk tcvpadinke eefveefnrl ktfanfpsgs pvsastlara gflytgegdt 61 vrcfschaav drwqygdsav grhrkvspnc rfingfylen satqstnsgi qngqykveny 121 lgsrdhfald rpsethadyl lrtgqvvdis dtiyprnpam yseearlksf qnwpdyahlt 181 prelasagly ytgigdqvqc fccggklknw epcdrawseh rrhfpncffv lgrnlnirse 241 sdayssdrnf pnstnlprnp smadyearif tfgtwiysvn keqlaragfy algegdkvkc 301 fhcgggltdw kpsedpweqh akwypgckyl legkggeyin nihlthslee clvrttektp 361 sltrriddti fqnpmvqeai rmgfsfkdik kimeekiqis gsnykslevl vadlvnaqkd 421 smgdessgts lqkeisteeq lrrlgeeklc kicmdrniai vfvpcghlvt ckqcaeavdk 481 cpmcytvitf kqkifms
```

EQUIVALENTS

It is to be understood that while the disclosure has been described in conjunction with the detailed description thereof, the foregoing description is intended to illustrate and not limit the scope of the invention, which is defined by the scope of the appended claims. Other aspects, advantages, and modifications are within the scope of the following claims:

SEQUENCE LISTING (452 sequences)

SEQ ID NO: 1 - protein, 529 aa, Listeria monocytogenes
MKKIMLVFITLILVSLPIAQQTEAKDASAFNKENSISSMAPPASPPASPKTPIEKKHADEIDKYIQGLDYNKNNVLVYHGDAVTNVPPRKGYKDGNEYIVVEKKKKSINQNNADIQVVNAISSLTYPGALVKANSELVENQPDVLPVKRDSLTLSIDLPGMTNQDNKIVVKNATKSNVNNAVNTLVERWNEKYAQAYPNVSAKIDYDDEMAYSESQLIAKFGTAFKAVNNSLNVNFGAISEGKMQEEVISFKQIYYNVNVNEPTRPSRFFGKAVTKEQLQALGVNAENPPAYISSVAYGRQVYLKLSTNSHSTKVKAAFDAAVSGKSVSGDVELTNIIKNSSFKAVIYGGSAKDEVQIIDGNLGDLRDILKKGATFNRETPGVPIAYTTNFLKDNELAVIKNNSEYIETTSKAYTDGKINIDHSGGYVAQFNISWDEVNYDPEGNEIVQHKNWSENNKSKLAHFTSSIYLPGNARNINVYAKECTGLAWEWWRTVIDDRNLPLVKNRNISIWGTTLYPKYSNKVDNPIE

SEQ ID NO: 2 - protein, 506 aa, Listeria monocytogenes
MKDASAFNKENSISSMAPPASPPASPKTPIEKKHADEIDKYIQGLDYNKNNVLVYHGDAVTNVPPRKGYKDGNEYIVVEKKKKSINQNNADIQVVNAISSLTYPGALVKANSELVENQPDVLPVKRDSLTLSIDLPGMTNQDNKIVVKNATKSNVNNAVNTLVERWNEKYAQAYPNVSAKIDYDDEMAYSESQLIAKFGTAFKAVNNSLNVNFGAISEGKMQEEVISFKQIYYNVNVNEPTRPSRFFGKAVTKEQLQALGVNAENPPAYISSVAYGRQVYLKLSTNSHSTKVKAAFDAAVSGKSVSGDVELTNIIKNSSFKAVIYGGSAKDEVQIIDGNLGDLRDILKKGATFNRETPGVPIAYTTNFLKDNELAVIKNNSEYIETTSKAYTDGKINIDHSGGYVAQFNISWDEVNYDPEGNEIVQHKNWSENNKSKLAHFTSSIYLPGNARNINVYAKECTGLAWEWWRTVIDDRNLPLVKNRNISIWGTTLYPKYSNKVDNPIE

SEQ ID NO: 3 - protein, 571 aa, Streptococcus pyogenes
MSNKKTFKKYSRVAGLLTAALIIGNLVTANAESNKQNTASTETTTTSEQPKPESSELTIEKAGQKMDDMLNSNDMIKLAPKEMPLESAEKEEKKSEDKKKSEEDHTEEINDKIYSLNYNELEVLAKNGETIENFVPKEGVKKADKFIVIERKKKNINTTPVDISIIDSVTDRTYPAALQLANKGFTENKPDAVVTKRNPQKIHIDLPGMGDKATVEVNDPTYANVSTAIDNLVNQWHDNYSGGNTLPARTQYTESMVYSKSQIEAALNVNSKILDGTLGIDFKSISKGEKKVMIAAYKQIFYTVSANLPNNPADVFDKSVTFKDLQRKGVSNEAPPLFVSNVAYGRTVFVKLETSSKSNDVEAAFSAALKGTDVKTNGKYSDILENSSFTAVVLGGDAAEHNKVVTKDFDVIRNVIKDNATFSRKNPAYPISYTSVFLKNNKIAGVNNRTEYVETTSTEYTSGKINLSHQGAYVAQYEILWDEINYDDKGKEVITKRRWDNNWYSKTSPFSTVIPLGANSRNIRIMARECTGLAWEWWRKVIDERDVKLSKEINVNISGSTLSPYGSITYK

SEQ ID NO: 4 - protein, 500 aa, Clostridium perfringens
MIRFKKTKLIASIAMALCLFSQPVISFSKDITDKNQSIDSGISSLSYNRNEVLASNGDKIESFVPKEGKKTGNKFIVVERQKRSLTTSPVDISIIDSVNDRTYPGALQLADKAFVENRPTILMVKRKPININIDLPGLKGENSIKVDDPTYGKVSGAIDELVSKWNEKYSSTHTLPARTQYSESMVYSKSQISSALNVNAKVLENSLGVDFNAVANNEKKVMILAYKQIFYTVSADLPKNPSDLFDDSVTFNDLKQKGVSNEAPPLMVSNVAYGRTIYVKLETTSSSKDVQAAFKALIKNTDIKNSQQYKDIYENSSFTAVVLGGDAQEHNKVVTKDFDEIRKVIKDNATFSTKNPAYPISYTSVFLKDNSVAAVHNKTDYIETTSTEYSKGKINLDHSGAYVAQFEVAWDEVSYDKEGNEVLTHKTWDGNYQDKTAHYSTVIPLEANARNIRIKARECTGLAWEWWRDVISEYDVPLTNNINVSIWGTTLYPGSSITYN

SEQ ID NO: 5 - protein, 471 aa, Streptococcus pneumoniae
MANKAVNDFILAMNYDKKKLLTHQGESIENRFIKEGNQLPDEFVVIERKKRSLSTNTSDISVTATNDSRLYPGALLVVDETLLENNPTLLAVDRAPMTYSIDLPGLASSDSFLQVEDPSNSSVRGAVNDLLAKWHQDYGQVNNVPARMQYEKITAHSMEQLKVKFGSDFEKTGNSLDIDFNSVHSGEKQIQIVNFKQIYYTVSVDAVKNPGDVFQDTVTVEDLKQRGISAERPLVYISSVAYGRQVYLKLETTSKSDEVEAAFEALIKGVKVAPQTEWKQILDNTEVKAVILGGDPSSGARVVTGKVDMVEDLIQEGSRFTADHPGLPISYTTSFLRDNVVATFQNSTDYVETKVTAYRNGDLLLDHSGAYVAQYYITWDELSYDHQGKEVLTPKAWDRNGQDLTAHFTTSIPLKGNVRNLSVKIRECTGLAWEWWRTVYEKTDLPLVRKRTISIWGTTLYPQVEDKVEND

SEQ ID NO: 6 - protein, 543 aa, Homo sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 7 - protein, 469 aa, Homo sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 8 - protein, 552 aa, Homo sapiens
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 9 - protein, 829 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 10 - protein, 784 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIEGRGERGSQRGNGGLQLARGRTRRS

SEQ ID NO: 11 - protein, 774 aa, Homo sapiens
MGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 12 - protein, 165 aa, Homo sapiens
MEMFQGLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 13 - protein, 165 aa, Homo sapiens; identical to SEQ ID NO: 12

SEQ ID NO: 14 - protein, 146 aa, Homo sapiens
MMWQKYAGSRRSMPLGARILFHGVFYAGGFAIVYYLIQKFHSRALYYKLAVEQLQSHPEAQEALGPPLNIHYLKLIDRENFVDIVDAKLKIPVSGSKSEGLLYVHSSRGGPFQRWHLDEVFLELKDGQQIPVFKLSGENGDEVKKE

SEQ ID NO: 15 - protein, 134 aa, Homo sapiens
MPLGARILFHGVFYAGGFAIVYYLIQKFHSRALYYKLAVEQLQSHPEAQEALGPPLNIHYLKLIDRENFVDIVDAKLKIPVSGSKSEGLLYVHSSRGGPFQRWHLDEVFLELKDGQQIPVFKLSGENGDEVKKE

SEQ ID NO: 16 - protein, 63 aa, Homo sapiens
MMWQKYAGSRRSMPLGARILFHGVFYAGGFAIVYYLIQSKYPASRLRPDLLLACSCSSIRGNT

SEQ ID NO: 17 - protein, 140 aa, Homo sapiens
MQEAGGQCLWEQGSFSTVCSMPGALPLCITSFKFHSRALYYKLAVEQLQSHPEAQEALGPPLNIHYLKLIDRENFVDIVDAKLKIPVSGSKSEGLLYVHSSRGGPFQRWHLDEVFLELKDGQQIPVFKLSGENGDEVKKE

SEQ ID NO: 18 - protein, 213 aa, Homo sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEAQRLMKKEQNKIGVKLS

SEQ ID NO: 19 - protein, 431 aa, Homo sapiens
MDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQTPIILTPSPLLSSIHFWSTLSPVAPLSPARLQGANTLFQFPSVLNSHGPFTLSGLDGPSTPGPFSPDLQKT

SEQ ID NO: 20 - protein, 405 aa, Homo sapiens
MDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQVACSLFMVSPLLSFICPFKQIQNLYTQVCFLLLRFVLERLCVTVM

SEQ ID NO: 21 - protein, 1255 aa, Homo sapiens [sequence omitted]

SEQ ID NO: 22 - protein, 1225 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 23 - protein, 1240 aa, Homo sapiens
MPRGSWKPQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 24 - protein, 1055 aa, Homo sapiens
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRNM

SEQ ID NO: 25 - protein, 603 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHS

SEQ ID NO: 26 - protein, 514 aa, Homo sapiens
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 27 - protein, 189 aa, Homo sapiens [sequence omitted]

SEQ ID NO: 28 - protein, 188 aa, Homo sapiens [sequence omitted]

SEQ ID NO: 29 - protein, 592 aa, Homo sapiens
MGRGLLRGLWPLHIVLWTRIASTIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 30 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 31 - protein, 911 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 32 - protein, 906 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVGTLRPDEKAIMTYVSCFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKKQTGSMDSDDFRALLISTGYSLGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 33 - protein, 509 aa, Homo sapiens
MVDGVMILPVLIMIALPSPSMEDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 34 - protein, 375 aa, Homo sapiens
MSTAGKVIKCKAAVLWELKKPFSIEEVEVAPPKAHEVRIKMVAAGICRSDEHVVSGNLVTPLPVILGHEAAGIVESVGEGVTTVKPGDKVIPLFTPQCGKCRICKNPESNYCLKNDLGNPRGTLQDGTRRFTCSGKPIHHFVGVSTFSQYTVVDENAVAKIDAASPLEKVCLIGCGFSTGYGSAVKVAKVTPGSTCAVFGLGGVGLSVVMGCKAAGAARIIAVDINKDKFAKAKELGATECINPQDYKKPIQEVLKEMTDGGVDFSFEVIGRLDTMMASLLCCHEACGTSVIVGVPPDSQNLSINPMLLLTGRTWKGAIFGGFKSKESVPKLVADFMAKKFSLDALITNILPFEKINEGFDLLRSGKSIRTVLTF

SEQ ID NO: 35 - protein, 412 aa, Homo sapiens
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 36 - protein, 709 aa, Homo sapiens
MAQRHSDSSLEEKLLGHRFHSELRLDAGGNPASGLPMVRGSPRVRDDAAFQPQVPAPPQPRPPGHEEPWPIVLSTESPAALKLGTQQLIPKSLAVASKAKTPARHQSFGAAVLSREAARRDPKLLPAPSFSLDDMDVDKDPGGMLRRNLRNQSYRAAMKGLGKPGGQGDAIQLSPKLQALAEEPSQPHTRSPAKNKKTLGRKRGHKGSFKDDPQLYQEIQERGLNTSQESDDDILDESSSPEGTQKVDATIVVKSYRPAQVTWSQLPEVVELGILDQLSTEERKRQEAMFEILTSEFSYQHSLSILVEEFLQSKELRATVTQMEHHHLFSNILDVLGASQRFFEDLEQRHKAQVLVEDISDILEEHAEKHFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERMEQMYTLHTQLDFSKVKSLPLISASRWLLKRGELFLVEETGLFRKIASRPTCYLFLFNDVLVVTKKKSEESYMVQDYAQMNHIQVEKIEPSELPLPGGGNRSSSVPHPFQVTLLRNSEGRQEQLLLSSDSASDRARWIVALTHSERQWQGLSSKGDLPQVEITKAFFAKQADEVTLQQADVVLVLQQEDGWLYGERLRDGETGWFPEDFARFITSRVAVEGNVRRMERLRVETDV

SEQ ID NO: 37 - protein, 456 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 38 - protein, 433 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 39 - protein, 404 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKYFGSVAEIIRNHQHSPLVLIDSQNNTKDSTRLKYAVKVS

SEQ ID NO: 40 - protein, 381 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKYFGSVAEIIRNHQHSPLVLIDSQNNTKDSTRLKYAVKVS

SEQ ID NO: 41 - protein, 299 aa, Homo sapiens
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKYFGSVAEIIRNHQHSPLVLIDSQNNTKDSTRLKYAVKVS

SEQ ID NO: 42 - protein, 994 aa, Homo sapiens
MRRRPPSRGGRGAARARETRRQPRHRSGRRMAEAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 43 - protein, 987 aa, Homo sapiens
MRCRNMFFSFKASLCGCGAATAPSLTAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 44 - protein, 256 aa, Homo sapiens
MFQTGGLIVFYGLLAQTMAQFGGLPVPLDQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 45 - protein, 484 aa, Homo sapiens
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 46 - protein, 443 aa, Homo sapiens
MYDDSYVPGFEDSEAGSADSYTSRPSLDSDVSLEEDRESARREVESQAQQQLERAKKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 47 - protein, 483 aa, Homo sapiens
MSFSDSSATFLLNEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 48 - protein, 471 aa, Homo sapiens
MEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 49 - protein, 277 aa, Homo sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 50 - protein, 251 aa, Homo sapiens
MDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 51 - protein, 182 aa, Homo sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQVIILGEIQRMAPGSSSRFVPC

SEQ ID NO: 52 - protein, 191 aa, Homo sapiens
MSDALIKVSMENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQVIILGEIQRMAPGSSSRFVPC

SEQ ID NO: 53 - protein, 156 aa, Homo sapiens
MDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQVIILGEIQRMAPGSSSRFVPC

SEQ ID NO: 54 - protein, 178 aa, Homo sapiens
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 55 - protein, 147 aa, Homo sapiens
MADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 56 - protein, 882 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 57 - protein, 821 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 58 - protein, 366 aa, Homo sapiens
MEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 59 - protein, 227 aa, Homo sapiens
MALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 60 - protein, 72 aa, Homo sapiens
MPLLRGRCPARRHYRRLALLGLQPAPRFAHSGPPRQRPLSAAEMAVGLVVFFTTFLTPAAYVLGNLKQFRRN

SEQ ID NO: 61 - protein, 773 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 62 - protein, 756 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETGIISQGPSSDT

SEQ ID NO: 63 - protein, 180 aa, Homo sapiens
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 64 - protein, 109 aa, Homo sapiens
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 65 - protein, 1164 aa, Homo sapiens
MAGAGGQHHPPGAAGGAAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPGSGDTESGSCEANSPGN

SEQ ID NO: 66 - protein, 1220 aa, Homo sapiens
MAGAGGQHHPPGAAGGAAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKDLGIPKVGHVKRILQGIKELGRSTPQSEV

SEQ ID NO: 67 - protein, 1100 aa, Homo sapiens
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKNTVGEKRDTKENGKHMDLGIPKVGHVKRILQGIKELGRSTPQSEV

SEQ ID NO: 68 - protein, 1084 aa, Homo sapiens
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKDLGIPKVGHVKRILQGIKELGRSTPQSEV

SEQ ID NO: 69 - protein, 919 aa, Homo sapiens
MWNISQGCTTGTPAPTPDPPSVTCAERVFLESPPMACPAKVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPGSGDTESGSCEANSPGN

SEQ ID NO: 70 - protein, 858 aa, Homo sapiens
MVNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVMRRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 71 - protein, 184 aa, Homo sapiens
MCGTGGTDSKTRRPPHRASFLKRLESKPLKMADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAK

SEQ ID NO: 72 - protein, 154 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAK

SEQ ID NO: 73 - protein, 2477 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 74 - protein, 2355 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 75 - protein, 2330 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 76 - protein, 2296 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 77 - protein, 2176 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 78 - protein, 657 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 79 - protein, 2446 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 80 - protein, 2267 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 81 - protein, 2265 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 82 - protein, 2240 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 83 - protein, 266 aa, Homo sapiens
MVCLRLPGGSCMAVLTVTLMVLSSPLALAGDTRPRFLEYSTSECHFFNGTERVRYLDRYFHNQEENVRFDSDVGEFRAVTELGRPDAEYWNSQKDLLEQKRGRVDNYCRHNYGVVESFTVQRRVHPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEWRARSESAQSKMLSGVGGFVLGLLFLGAGLFIYFRNQKGHSGLQPRGFLS

SEQ ID NO: 84 - protein, 266 aa, Homo sapiens
MVCLKLPGGSCMAALTVTLMVLSSPLALAGDTQPRFLWQGKYKCHFFNGTERVQFLERLFYNQEEFVRFDSDVGEYRAVTELGRPVAESWNSQKDILEDRRGQVDTVCRHNYGVGESFTVQRRVHPEVTVYPAKTQPLQHHNLLVCSVSGFYPGSIEVRWFRNGQEEKAGVVSTGLIQNGDWTFQTLVMLETVPRSGEVYTCQVEHPSVMSPLTVEWRARSESAQSKMLSGVGGFVLGLLFLGAGLFIYFRNQKGHSGLQPTGFLS

SEQ ID NO: 85 - protein, 266 aa, Homo sapiens
MVCLKFPGGSCMAALTVTLMVLSSPLALAGDTRPRFLEQVKHECHFFNGTERVRFLDRYFYHQEEYVRFDSDVGEYRAVTELGRPDAEYWNSQKDLLEQRRAEVDTYCRHNYGVVESFTVQRRVYPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEWRARSESAQSKMLSGVGGFVLGLLFLGAGLFIYFRNQKGHSGLQPTGFLS

SEQ ID NO: 86 - protein, 266 aa, Homo sapiens
MVCLKLPGGSCMTALTVTLMVLSSPLALSGDTRPRFLWQPKRECHFFNGTERVRFLDRYFYNQEESVRFDSDVGEFRAVTELGRPDAEYWNSQKDILEQARAAVDTYCRHNYGVVESFTVQRRVQPKVTVYPSKTQPLQHHNLLVCSVSGFYPGSIEVRWFLNGQEEKAGMVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 87 - protein, 266 aa, Homo sapiens
MVCLKLPGGSYMAKLTVTLMVLSSPLALAGDTRPRFLQQDKYECHFFNGTERVRFLHRDIYNQEEDLRFDSDVGEYRAVTELGRPDAEYWNSQKDFLEDRRAAVDTYCRHNYGVGESFTVQRRVEPKVTVYPARTQTLQHHNLLVCSVNGFYPGSIEVRWFRNSQEEKAGVVSTGLIQNGDWTFQTLVMLETVPRSGEVYTCQVEHPSVTSPLTVEWRAQSESAQSKMLSGVGGFVLGLLFLGAGLFIYFKNQKGHSGLHPTGLVS

SEQ ID NO: 88 - protein, 310 aa, Homo sapiens
MGDVLEQFFILTGLLVCLACLAKCVRFSRCVLLNYWKVLPKSFLRSMGQWAVITGAGDGIGKAYSFELAKRGLNVVLISRTLEKLEAIATEIERTTGRSVKIIQADFTKDDIYEHIKEKLAGLEIGILVNNVGMLPNLLPSHFLNAPDEIQSLIHCNITSVVKMTQLILKHMESRQKGLILNISSGIALFPWPLYSMYSASKAFVCAFSKALQEEYKAKEVIIQVLTPYAVSTAMTKYLNTNVITKTADEFVKESLNYVTIGGETCGCLAHEILAGFLSLIPAWAFYSGAFQRLLLTHYVAYLKLNTKVR

SEQ ID NO: 89 - protein, 1019 aa, Homo sapiens [sequence omitted]

SEQ ID NO: 90 - protein, 464 aa, Homo sapiens
MSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 91 - protein, 1019 aa, Homo sapiens
MRYRLAWLLHPALPSTFRSVLGARLPPPERLCGFQKKTYSKMNNPAIKRIGNHITKSPEDKREYRGLELANGIKVLLISDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGNKYTLETRPNQEGIDVRQELLKFHSAYYSSNLMAVCVLGRESLDDLTNLVVKLFSEVENKNVPLPEFPEHPFQEEHLKQLYKIVPIKDIRNLYVTFPIPDLQKYYKSNPGHYLGHLIGHEGPGSLLSELKSKGWVNTLVGGQKEGARGFMFFIINVDLTEEGLLHVEDIILHMFQYIQKLRAEGPQEWVFQECKDLNAVAFRFKDKERPRGYTSKIAGILHYYPLEEVLTAEYLLEEFRPDLIEMVLDKLRPENVRVAIVSKSFEGKTDRTEEWYGTQYKQEAIPDEVIKKWQNADLNGKFKLPTKNEFIPTNFEILPLEKEATPYPALIKDTAMSKLWFKQDDKFFLPKACLNFEFFSRYIYADPLHCNMTYLFIRLLKDDLKEYTYAARLSGLSYGIASGMNAILLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 92 - protein, 980 aa, Homo sapiens
MRYRLAWLLHPALPSTFRSVLGARLPPPERLCGFQKKTYSKMNNPAIKRIGNHITKSPEDKREYRGLELANGIKVLLISDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGRESLDDLTNLVVKLFSEVENKNVPLPEFPEHPFQEEHLKQLYKIVPIKDIRNLYVTFPIPDLQKYYKSNPGHYLGHLIGHEGPGSLLSELKSKGWVNTLVGGQKEGARGFMFFIINVDLTEEGLLHVEDIILHMFQYIQKLRAEGPQEWVFQECKDLNAVAFRFKDKERPRGYTSKIAGILHYYPLEEVLTAEYLLEEFRPDLIEMVLDKLRPENVRVAIVSKSFEGKTDRTEEWYGTQYKQEAIPDEVIKKWQNADLNGKFKLPTKNEFIPTNFEILPLEKEATPYPALIKDTAMSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 93 - protein, 978 aa, Homo sapiens
MNNPAIKRIGNHITKSPEDKREYRGLELANGIKVLLISDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGNKYTLETRPNQEGIDVRQELLKFHSAYYSSNLMAVCVLGRESLDDLTNLVVKLFSEVENKNVPLPEFPEHPFQEEHLKQLYKIVPIKDIRNLYVTFPIPDLQKYYKSNPGHYLGHLIGHEGPGSLLSELKSKGWVNTLVGGQKEGARGFMFFIINVDLTEEGLLHVEDIILHMFQYIQKLRAEGPQEWVFQECKDLNAVAFRFKDKERPRGYTSKIAGILHYYPLEEVLTAEYLLEEFRPDLIEMVLDKLRPENVRVAIVSKSFEGKTDRTEEWYGTQYKQEAIPDEVIKKWQNADLNGKFKLPTKNEFIPTNFEILPLEKEATPYPALIKDTAMSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 94 - protein, 464 aa, Homo sapiens
MSKLWFKQDDKFFLPKACLNFEFFSRYIYADPLHCNMTYLFIRLLKDDLKEYTYAARLSGLSYGIASGMNAILLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 95 - protein, 403 aa, Homo sapiens [sequence omitted]

SEQ ID NO: 96 - protein, 272 aa, Homo sapiens
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIERDSREHEEPTTSEMAEETYSPKIFRPKHTRISELKAEAVKKDRRKKLTQSKFVGGAENTAHPRIISAPEMRQESEQGPCRRHMEASLQELKASPRMVPRAVYLPNCDRKGFYKRKQCKPSRGRKRGICWCVDKYGMKLPGMEYVDGDFQCHTFDSSNVE

SEQ ID NO: 97 - protein, 282 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 98 - protein, 279 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGTQ

SEQ ID NO: 99 - protein, 336 aa, Homo sapiens
MLQSLAGSSCVRLVERHRSAWCFGFLVLGYLLYLVFGAVVFSSVELPYEDLLRQELRKLKRRFLEEHECLSEQQLEQFLGRVLEASNYGVSVLSNASGNWNWDFTSALFFASTVLSTTGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 100 - protein, 416 aa, Homo sapiens
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 101 - protein, 319 aa, Homo sapiens
MPRGQKSKLRAREKRRKARDETRGLNVPQVTEAEEEEAPCCSSSVSGGAASSSPAAGIPQEPQRAPTTAAAAAAGVSSTKSKKGAKSHQGEKNASSSQASTSTKSPSEDPLTRKSGSLVQFLLYKYKIKKSVTKGEMLKIVGKRFREHFPEILKKASEGLSVVFGLELNKVNPNGHTYTFIDKVDLTDEESLLSSWDFPRRKLLMPLLGVIFLNGNSATEEEIWEFLNMLGVYDGEEHSVFGEPWKLITKDLVQEKYLEYKQVPSSDPPRFQFLWGPRAYAETSKMKVLEFLAKVNGTTPCAFPTHYEEALKDEEKAGV

SEQ ID NO: 102 - protein, 365 aa, Homo sapiens
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 103 - protein, 520 aa, Homo sapiens
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPAGVKGEQGSPGLAGPKGAPGQAGQKGDQGVKGSSGEQGVKGEKGERGENSVSVRIVGSSNRGRAEVYYSGTWGTICDDEWQNSDAIVFCRMLGYSKGRALYKVGAGTGQIWLDNVQCRGTESTLWSCTKNSWGHHDCSHEEDAGVECSV

SEQ ID NO: 104 - protein, 572 aa, Homo sapiens
MEPEAPRRRHTHQRGYLLTRNPHLNKDLAFTLEERQQLNIHGLLPPSFNSQEIQVLRVVKNFEHLNSDFDRYLLLMDLQDRNEKLFYRVLTSDIEKFMPIVYTPTVGLACQQYSLVFRKPRGLFITIHDRGHIASVLNAWPEDVIKAIVVTDGERILGLGDLGCNGMGIPVGKLALYTACGGMNPQECLPVILDVGTENEELLKDPLYIGLRQRRVRGSEYDDFLDEFMEAVSSKYGMNCLIQFEDFANVNAFRLLNKYRNQYCTFNDDIQGTASVAVAGLLAALRITKNKLSDQTILFQGAGEAALGIAHLIVMALEKEGLPKEKAIKKIWLVDSKGLIVKGRASLTQEKEKFAHEHEEMKNLEAIVQEIKPTALIGVAAIGGAFSEQILKDMAAFNERPIIFALSNPTSKAECSAEQCYKITKGRAIFASGSPFDPVTLPNGQTLYPGQGNNSYVFPGVALGVVACGLRQITDNIFLTTAEVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 105 - protein, 388 aa, Homo sapiens
MVEAEELAQLRLLNLELLRQLWVGQDAVRRSVARAASESSLESSSSYNSETPSTPETSSTSLSTSCPRGRSSVWGPPDACRGDLRDVARSGVASLPPAKCQHQESLGRPRPHSAPSLGTSSLRDPEPSGRLGDPGPQEAQTPRSILAQQSKLSKPRVTFSEESAVPKRSWRLRPYLGYDWIAGSLDTSSSITSQPEAFFSKLQEFRETNKEECICSHPEPQLPGLRESSGSGVEEDHECVYCYRVNRRLFPVPVDPGTPCRLCRTPRDQQGPGTLAQPAHVRVSIPLSILEPPHRYHIHRRKSFDASDTLALPRHCLLGWDIFPPKSEKSSAPRNLDLWSSVSAEAQHQKLSGTSSPFHPASPMQMLPPTPTWSVPQVPRPHVPRQKP

SEQ ID NO: 106 - protein, 470 aa, Homo sapiens
MKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 107 - protein, 267 aa, Homo sapiens
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 108 - protein, 269 aa, Homo sapiens
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 109 - protein, 209 aa, Homo sapiens
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGAQSYMHS

SEQ ID NO: 110 - protein, 119 aa, Homo sapiens
MAASAGAGAVIAAPDSRRWLWSVLAAALGLLTAGVSALEVYTPKEIFVANGTQGKLTCKFKSTSTTGGLTSVSWSFQPEGADTTVSGPVIYAQLDHSGGHHSDKINKSESVVYADIRKN

SEQ ID NO: 111 - protein, 451 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLTPFTKVRLVGGSGPHEGRVEILHSGQWGTICDDRWEVRVGQVVCRSLGYPGVQAVHKAAHFGQGTGPIWLNEVFCFGRESSIEECKIRQWGTRACSHSEDAGVTCTL

SEQ ID NO: 112 - protein, 358 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLRPVQLTDHIRAGPS

SEQ ID NO: 113 - protein, 388 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLSTGPIWLNEVFCFGRESSIEECKIRQWGTRACSHSEDAGVTCTL

SEQ ID NO: 114 - protein, 610 aa, Homo sapiens
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTGERPFICELCGNSYTDIKNLKKHKTKVHSGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 115 - protein, 581 aa, Homo sapiens
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 116 - protein, 390 aa, Homo sapiens
MRTRTGSQLAAREVTGSGAVPRQLEGRRCQAGRDANGGTSSDGSSSMAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 117 - protein, 293 aa, Homo sapiens
MVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 118 - protein, 420 aa, Homo sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 119 - protein, 354 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQQLYQIQQVTMPAGQDLAQPMFIQSANQPSDGQAPQVTGD

SEQ ID NO: 120 - protein, 335 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 121 - protein, 334 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQLYQIQQVTMPAGQDLAQPMFIQSANQPSDGQAPQVTGD

SEQ ID NO: 122 - protein, 297 aa, Homo sapiens
MSTEGGFGGTSSSDAQQSLQSFWPRVMEEIRNLTVKDFRVQELPLARIKKIMKLDEDVKRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 123 - protein, 301 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 124 - protein, 458 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 125 - protein, 439 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 126 - protein, 705 aa, Homo sapiens
MGFMLPLIFRYSPRLMEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 127 - protein, 690 aa, Homo sapiens
MEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 128 - protein, 431 aa, Homo sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 129 - protein, 414 aa, Homo sapiens
MVFHLRTRYEQANCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 130 - protein, 345 aa, Homo sapiens
MGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 131 - protein, 937 aa, Homo sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 132 - protein, 393 aa, Homo sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACGK

SEQ ID NO: 133 - protein, 250 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQEEDTAPWRC

SEQ ID NO: 134 - protein, 453 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 135 - protein, 480 aa, Homo sapiens
MASDSIFESFPSYPQCFMRECILGMNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 136 - protein, 248 aa, Homo sapiens
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 137 - protein, 263 aa, Homo sapiens
MRPCQVPGAATGPRAMWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 138 - protein, 214 aa, Homo sapiens
MRPCQVPGAATGPRAMWLCPLALNLILMAASGAVCEVKDVCVGTPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 139 - protein, 199 aa, Homo sapiens
MWLCPLALNLILMAASGAVCEVKDVCVGTPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 140 - protein, 248 aa, Homo sapiens
MWLCPLALTLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 141 - protein, 258 aa, Homo sapiens
MPGAATGPRAMWLCPLALTLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 142 - protein, 393 aa, Homo sapiens
MHQAGYPGCRGAMAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 143 - protein, 197 aa, Homo sapiens [sequence omitted]

SEQ ID NO: 144 - protein, 191 aa, Homo sapiens
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFQAKPAVPTSKLGQAEGRDAGSAPSGGDPAFLGMAVSTLCGEVPLYYI

SEQ ID NO: 145 - protein, 144 aa, Homo sapiens
MDVGSKEVLMESPPVLEMSIGAPEAQQRLALSEHLVTTATFSIGSTGLVVYDYQQLLIAYKPAPGTCCYIMKIAPESIPSLEALTRKVHNFQMECSLQAKPAVPTSKLGQAEGRDAGSAPSGGDPAFLGMAVSTLCGEVPLYYI

SEQ ID NO: 146 - protein, 375 aa, Homo sapiens
MLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGPPGPPGVPGPAGREGPLGKQGNIGPQGKPGPKGEAGPKGEVGAPGMQGSAGARGLAGPKGERGVPGERGVPGNTGAAGSAGAMGPQGSPGARGPPGLKGDKGIPGDKGAKGESGLPDVASLRQQVEALQGQVQHLQAAFSQYKKVELFPNGQSVGEKIFKTAGFVKPFTEAQLLCTQAGGQLASPRSAAENAALQQLVVAKNEAAFLSMTDSKTEGKFTYPTGESLVYSNWAPGEPNDDGGSEDCVEIFTNGKWNDRACGEKRLVVCEF

SEQ ID NO: 147 - protein, 501 aa, Homo sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 148 - protein, 244 aa, Homo sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGEFRTSREHPHPFTTTLGPLLVFQSHHHRTGLSADWSLLTGWMSLGGPSCPEPT

SEQ ID NO: 149 - protein, 457 aa, Homo sapiens
MGTTWLLSTPQHWTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 150 - protein, 354 aa, Homo sapiens
MYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 151 - protein, 1321 aa, Homo sapiens
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKVSNSPEPQKAVEQEDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 152 - protein, 1311 aa, Homo sapiens
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFVPTRFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 153 - protein, 1307 aa, Homo sapiens
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 154 - protein, 1177 aa, Homo sapiens
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETVILHQGRLLGLRANKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 155 - protein, 333 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDSADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 156 - protein, 365 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDIETGFHRVGQAGLQLLTSSDPPALDSQSAGITGADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 157 - protein, 277 aa, Homo sapiens
MLSQKEVAVADAKKSLELNPNNSTAMLRKGICEYHEKNYAAALETFTEGQKLDSADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 158 - protein, 296 aa, Homo sapiens
MALTSDLGKQIKLKEVEGTLLQPATVDNWSQIQSFEAKPDDLLICTYPKAGTTWIQEIVDMIEQNGDVEKCQRAIIQHRHPFIEWARPPQPSGVEKAKAMPSPRILKTHLSTQLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 159 - protein, 307 aa, Homo sapiens
MALTSDLGKQIKLKEVEGTLLQPATVDNWSQIQSFEAKPDDLLICTYPKAGTTWIQEIVDMIEQNGDVEKCQRAIIQHRHPFIEWARPPQPSETGFHHVAQAGLKLLSSSNPPASTSQSAKITDLLPPSFWENNCKFLYVARNAKDCMVSYYHFQRMNHMLPDPGTWEEYFETFINGKVVWGSWFDHVKGWWEMKDRHQILFLFYEDIKRDPKHEIRKVMQFMGKKVDETVLDKIVQETSFEKMKENPMTNRSTVSKSILDQSISSFMRKGTVGDWKNHFTVAQNERFDEIYRRKMEGTSINFCMEL

SEQ ID NO: 160 - protein, 163 aa, Homo sapiens
MSWRPQPCCISSCCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 161 - protein, 183 aa, Homo sapiens
MGVRVHVVAASALLYFILLSGTRCEENCGNPEHCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 162 - protein, 1087 aa, Homo sapiens
MADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 163 - protein, 543 aa, Homo sapiens
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 164 - protein, 950 aa, Homo sapiens
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 165 - protein, 543 aa, Homo sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 166 - protein, 609 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 167 - protein, 451 aa, Homo sapiens
MNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGERIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 168 - protein, 2131 aa, Homo sapiens
MPLSPPAQGDPGEPSPCRPPKKHTTFHLWRSKKKQQPAPPDCGVFVPHPLPAPAGEARALDVVDGKYVVRDSQEFPLHCGESQFFHTTSEALGSLLLESGIFKKSRAQPPEDNRRKPVLGKLGTLFTAGRRRNSRNGLESPTRSNAKPLSPKDVVASPKLPERESERSRSQSSQLKQTDTSEEGSPRENPREAEGELPESGGPAAPPDAELSPRWSSSAAAVAVQQCHENDSPQLEPLEAEGEPFPDATTTAKQLHSSPGNSSRQENAETPARSPGEDASPGAGHEQEAFLGVRGAPGSPTQERPAGGLGEAPNGAPSVCAEEGSLGPRNARSQPPKGASDLPGEPPAEGAAHTASSAQADCTARPKGHAHPAKVLTLDIYLSKTEGAQVDEPVVITPRAEDCGDWDDMEKRSSGRRSGRRRGSQKSTDSPGADAELPESAARDDAVFDDEVAPNAASDNASAEKKVKSPRAALDGGVASAASPESKPSPGTKGQLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMEKANHIESVIKSNLPNCANSDTDFMGLFKSSRYDPSISFSGMSLSDTMTLRGSVQNKLNPRPGKVVIYSEPDVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTWLIYEEPGFQGVPFILEPGEYPDLSFWDTEEAYIGSMRPLKMGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDVEFSEPTIILFEREDFKGKKIELNAETVNLRSLGFNTQIRSVQVIGGIWVTYEYGSYRGRQFLLSPAEVPNWYEFSGCRQIGSLRPFVQKRIYFRLRNKATGLFMSTNGNLEDLKLLRIQVMEDVGADDQIWIYQEGCIKCRIAEDCCLTIVGSLVTSGSKLGLALDQNADSQFWSLKSDGRIYSKLKPNLVLDIKGGTQYDQNHIILNTVSKEKFTQVWEAMVLYT

SEQ ID NO: 169 - protein, 854 aa, Homo sapiens
MMAYSDTTMMSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 170 - protein, 845 aa, Homo sapiens
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 171 - protein, 1620 aa, Homo sapiens
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 172 - protein, 552 aa, Homo sapiens
MQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 173 - protein, 496 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 174 - protein, 495 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 175 - protein, 444 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 176 - protein, 498 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 177 - protein, 497 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 178 - protein, 298 aa, Homo sapiens
MEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 179 - protein, 1341 aa, Homo sapiens
MTKRKKTINLNIQDAQKRTALHWACVNGHEEVVTFLVDRKCQLDVLDGEHRTPLMKALQCHQEACANILIDSGADINLVDVYGNTALHYAVYSEILSVVAKLLSHGAVIEVHNKASLTPLLLSITKRSEQIVEFLLIKNANANAVNKYKCTALMLAVCHGSSEIVGMLLQQNVDVFAADICGVTAEHYAVTCGFHHIHEQIMEYIRKLSKNHQNTNPEGTSAGTPDEAAPLAERTPDTAESLVEKTPDEAAPLVERTPDTAESLVEKTPDEAASLVEGTSDKIQCLEKATSGKFEQSAEETPREITSPAKETSEKFTWPAKGRPRKIAWEKKEDTPREIMSPAKETSEKFTWAAKGRPRKIAWEKKETPVKTGCVARVTSNKTKVLEKGRSKMIACPTKESSTKASANDQRFPSESKQEEDEEYSCDSRSLFESSAKIQVCIPESIYQKVMEINREVEEPPKKPSAFKPAIEMQNSVPNKAFELKNEQTLRADPMFPPESKQKDYEENSWDSESLCETVSQKDVCLPKATHQKEIDKINGKLEESPNKDGLLKATCGMKVSIPTKALELKDMQTFKAEPPGKPSAFEPATEMQKSVPNKALELKNEQTLRADEILPSESKQKDYEENSWDTESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNQEEEKRRNADILNEKIREELGRIEEQHRKELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQYEKEKAETENS

SEQ ID NO: 180 - protein, 920 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 181 - protein, 388 aa, Homo sapiens
MILWLHSLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 182 - protein, 644 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGEKFRVGNCKHLKMTRP

SEQ ID NO: 183 - protein, 648 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGAAVVVSERILRVFGVSEWLP

SEQ ID NO: 184 - protein, 572 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRNTRRKRLWKLIIRSINSCICSPRETEVPVRQQK

SEQ ID NO: 185 - protein, 470 aa, Homo sapiens
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 186 - protein, 43 aa, Homo sapiens
MAARAVFLALSAQLLQARLMKEESPVVSWRLEPEDGTALCFIF

SEQ ID NO: 187 - DNA, 2978 bp, Homo sapiens
gcacctgcagggagggcaggcagctagcctgaaggctgatccccccttcctgttagcacttttgatgggactagtggactttggttcagaaggaagagctatgcttgttagggcctcttgtctcctcccaggagtggacaaggtgggttaggagcagtttctccctgagtggctgctgctgggtggttgaggagatgcacggcttctgttcctagtcacaaggctgcagcagacgctcctcagatgctctgtgccttggatctggccccactcccgtcctcccagccctcctctcctccagctacctgccagccggcacttttggtcaagctgttttgcattcactgttgcacatatgctcagtcacacacacagcatacgctatgcacatgtgtccacacacaccccacccacatcccacatcaccccgaccccctctgctgtccttggaaccttattacacttcgagtcactggtttgcctgtattgtgaaaccagctggatcctgagatccccaagacagaaatcatgatgagtatgtttttggcccatgacactggcttaccttgtgccaggcagatggcagccacacagtgtccaccggatggttgattttgaagcagagttagcttgtcacctgcctccctttcccgggacaacagaagctgacctctttgatctcttgcgcagatgatgagtctccggggctctatgggtttctgaatgtcatcgtccactcagccactggatttaagcagagttcaagtaagtactggtttggggaggagggttgcagcggccgagccagggtctccacccaggaaggactcatcgggcagggtgtggggaaacagggaggttgttcagatgaccacgggacacctttgaccctggccgctgtggagtgtttgtgctggttgatgccttctgggtgtggaattgtttttcccggagtggcctctgccctctcccctagcctgtctcagatcctgggagctggtgagctgccccctgcaggtggatcgagtaattgcaggggtttggcaaggactttgacagacatccccaggggtgcccgggagtgtggggtccaagccaggagggctgtcagcagtgcaccttcaccccacagcagagcagatttggctgctctgtcgagctggatggatactactttttttttcctttccctctaagtgggggtctcccccagctactggagctgtcagaacagtgaaggctggtaacacatgagttgcactgtgtaagtttctcgaggccgggcgcagtggctcatgcctgtaatcccagcactttgggaggctgaggcaggtggatcgcttgagctcaggagttggagaccagcctgaccaacatggtgaaaccctgtgtctactaaaaatacaaagattagccgggctaggcagtgggcacctgtaatcacaactgcttgggaggctgagggaagagaatcgcttgaacccaggaggcggaggttgcagtgagccgagcttgtgccactgcattccagcctgggcgacagagcaagactccgcctcaaaaaaaaaaaaaaaaagttcctagaaacagcaaaatgtggagacagaaagcttaccagggattgttggggaatggggttgggagagaggactaactgcagatgaacccaagggggactttttaggtgagagcagtgtcgtgaaaagactgtggtgctgtttgcgctcacatttacatttcctaaaattctttaaaccctacacttggaatggatgaattacatgacatgcagattgcaccttcataacataatctttctcctgggcccctgtctctggctgcctcataaacgctggtgtttccctcgtgggcctccctgcatccctgcatctcctcccgggtcctgtctgtgagcaatacagcgtgacaccctacgctgccccgtggtcccgggcttgtctctccttgcctccctgttacctttctttctatctcttccttgccccgtgcactcaaccttgcatccccaaaccaaacctattattcatggaccccaaacttgttcctcttatgtcctgtccctttgaggggcaccaccatccacccgcatggccaagccagaaaccgtggtctgctctccctccgttaaatgccattctccatcagtgaggcttcttagtcatctctggctgcctggccaggccctggctgtggcctcctccctggtctttgtagctctggatatccctgcagaaagggtccccactaccaggcctctccatccccagtctcaggtagtttttctaaaatgcaaaccccaccctgcaacttaccgcccacagcccagcccactcttctccaggcctcgcctccctcccttccccctgcaccccacgacttctccagcactgagctgcttcctgtgccccacagtggcctggagtcccctttgccttaactctttgccccatagtacagcggggtctgctctgattgtaggggcttcccacatcccccaggatggctgccctctgctgtggcatcactgtgtaacaatggcgtgtacacctctctgtccccaccagtgcagggcccttctcatcgtaggggctttagctggggtttgtggatcgactgagtgaacgaatgttgtgggaagtcccgtttcccagccgcacccagggaaattccacagagcgggcaggggcatcgcatgaggtgctggtgttcacgccagaccacaattaggtgtttaatttttaaaaagaaagttacaaccttttttttttatttttattttttctgattctgcaaataacacctgctcttacagaccatgtgggtgatgtggaaaagacctgtgaccttctccatgtccacttctccccacagatctgtactgcaccctggaggtggattcctttgggtattttgtgaataaagcaaagacgcgcgtctacagggacacagctgagcca

SEQ ID NO: 188 - protein, 766 aa, Homo sapiens [sequence omitted]

SEQ ID NO: 189 - protein, 767 aa, Homo sapiens
MAALSGGGGGGAEPGQALFNGDMEPEAGAGAGAAASSAADPAIPEEVWNIKQMIKLTQEHIEALLDKFGGEHNPPSIYLEAYEEYTSKLDALQQREQQLLESLGNGTDFSVSSSASMDTVTSSSSSSLSVLPSSLSVFQNPTDVARSNPKSPQKPIVRVFLPNKQRTVVPARCGVTVRDSLKKALMMRGLIPECCAVYRIQDGEKKPIGWDTDISWLTGEELHVEVLENVPLTTHNFVRKTFFTLAFCDFCRKLLFQGFRCQTCGYKFHQRCSTEVPLMCVNYDQLDLLFVSKFFEHHPIPQEEASLAETALTSGSSPSAPASDSIGPQILTSPSPSKSIPIPQPFRPADEDHRNQFGQRDRSSSAPNVHINTIEPVNIDDLIRDQGFRGDGGSTTGLSATPPASLPGSLTNVKALQKSPGPQRERKSSSSSEDRNRMKTLGRRDSSDDWEIPDGQITVGQRIGSGSFGTVYKGKWHGDVAVKMLNVTAPTPQQLQAFKNEVGVLRKTRHVNILLFMGYSTKPQLAIVTQWCEGSSLYHHLHIIETKFEMIKLIDIARQTAQGMDYLHAKSIIHRDLKSNNIFLHEDLTVKIGDFGLATVKSRWSGSHQFEQLSGSILWMAPEVIRMQDKNPYSFQSDVYAFGIVLYELMTGQLPYSNINNRDQIIFMVGRGYLSPDLSKVRSNCPKAMKRLMAECLKKKRDERPLFPQILASIELLARSLPKIHRSASEPSLNRAGFQTEDFSLYACASPKTPIQAGGYGEFAAFK

SEQ ID NO: 190 - protein, 459 aa, Homo sapiens
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 191 - protein, 433 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMTVKNKYATSKHAKISTLPQLNSALVQDLAKAVAKV

SEQ ID NO: 192 - protein, 396 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTVKNKYATSKHAKISTLPQLNSALVQDLAKAVAKV

SEQ ID NO: 193 - protein, 380 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLENNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMTVKNKYATSKHAKISTLPQLNSALVQDLAKAVAKV

SEQ ID NO: 194 - protein, 534 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 195 - protein, 316 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 196 - protein, 388 aa, Homo sapiens
MTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 197 - protein, 252 aa, Homo sapiens
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAGIVTGVLVGVALVAALVCFLLLAKTGRTSIQRDLKEQQPQALAPGRGPSHSSAFSMSPLSTAQAPLPNPRTAASIYEELLKHDTNIYCRMDHKAEVAS

SEQ ID NO: 198 - protein, 212 aa, Homo sapiens
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAGIVTGVLVGVALVAALVCFLLLAKTGRPWSLPQLCLLDVPSLHCPGPPTQPQDSSFHL

SEQ ID NO: 199 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 200 - protein, 701 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 201 - protein, 618 aa, Homo sapiens
MHKTASQRLFPGPSYQNIKSIMEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 202 - protein, 569 aa, Homo sapiens
MSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 203 - protein, 127 aa, Homo sapiens
MWMGLIQLVEGVKRKDQGFLEKEFYHKTNIKMRCEFLACWPAFTVLGEAWRDQVDWSRLLRDTGLVKMSRKPRASSPLSNNHPPTPKRRGSGRHPLNPGPEALSKFPRQPGREKGPIKEVPGTKGSP

SEQ ID NO: 204 - protein, 110 aa, Homo sapiens
MWMGLIQLVEGVKRKDQGFLEKEFYHKTNIKMRCEFLACWPAFTVLGEAWRDQVDWSRLLRDTGLVKMSRKPRASSPLSNNHPPTPKRFPRQPGREKGPIKEVPGTKGSP

SEQ ID NO: 205 - protein, 2322 aa, Homo sapiens
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 206 - protein, 180 aa, Homo sapiens
MQAEGRGTGGSTGDADGPGGPGIPDGPGGNAGGPGEAGATGGRGPRGAGAARASGPRGGAPRGPHGGAASAQDGRCPCGARRPDSRLLELHITMPFSSPMEAELVRRILSRDAAPLPRPGAVLKDFTVSGNLLFIRLTAADHRQLQLSISSCLQQLSLLMWITQCFLPVFLAQAPSGQRR

SEQ ID NO: 207 - protein, 210 aa, Homo sapiens
MQAEGRGTGGSTGDADGPGGPGIPDGPGGNAGGPGEAGATGGRGPRGAGAARASGPRGGAPRGPHGGAASAQDGRCPCGARRPDSRLLELHITMPFSSPMEAELVRRILSRDAAPLPRPGAVLKDFTVSGNLLFMSVRDQDREGAGRMRVVGWGLGSASPEGQKARDLRTPKHKVSEQRPGTPGPPPPEGAQGDGCRGVAFNVMFSAPHI

SEQ ID NO: 208 - protein, 663 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 209 - protein, 662 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDAAAEEASTTKGEQFPGEMFPVACRETTARVKEEVDEGVTCEMLLNTMDK

SEQ ID NO: 210 - protein, 700 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDNSAGCTGRMMLVSAWLLGRPQETYNQGRRRRGSRRVTW

SEQ ID NO: 211 - protein, 665 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDGVISAHRNLCLLGSSDSHASVSGAGITDARHHAWLIVLLFLVEMGFYHVSHS

SEQ ID NO: 212 - protein, 627 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWILWVGNSEVAELGGPGSGPLLRLQSGCPPGLHHPKAGLGPEDPLPGQLRHTTAGTGLSSLLQGPLCRAA

SEQ ID NO: 213 - protein, 613 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 214 - protein, 573 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWITSKWSGLKPQTFIT

SEQ ID NO: 215 - protein, 483 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEERHMTAHIRTHTGEKPFTCLSCNKCFRQKQLLNAHFRKYHDANFIPTVYKCSKCGKGFSRWILWVGNSEVAELGGPGSGPLLRLQSGCPPGLHHPKAGLGPEDPLPGQLRHTTAGTGLSSLLQGPLCRAA

SEQ ID NO: 216 - protein, 460 aa, Homo sapiens
MSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDGVISAHRNLCLLGSSDSHASVSGAGITDARHHAWLIVLLFLVEMGFYHVSHS

SEQ ID NO: 217 - protein, 422 aa, Homo sapiens
MSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWILWVGNSEVAELGGPGSGPLLRLQSGCPPGLHHPKAGLGPEDPLPGQLRHTTAGTGLSSLLQGPLCRAA

SEQ ID NO: 218 - protein, 404 aa, Homo sapiens
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEVKPFLDLKLHGILVEAAVQVTPSVTNSRICYKQAFYYSYKIYAGNNMHSLL

SEQ ID NO: 219 - protein, 403 aa, Homo sapiens
MFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDGVISAHRNLCLLGSSDSHASVSGAGITDARHHAWLIVLLFLVEMGFYHVSHS

SEQ ID NO: 220 - protein, 299 aa, Homo sapiens
MFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWVLY

SEQ ID NO: 221 - protein, 543 aa, Homo sapiens
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPLKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 222 - protein, 1210 aa, Homo sapiens [sequence omitted]

SEQ ID NO: 223 - protein, 628 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGS

SEQ ID NO: 224 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 225 - protein, 705 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 226 - protein, 1091 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 227 - protein, 1136 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 228 - protein, 1165 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 229 - protein, 1157 aa, Homo sapiens
MFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 230 - protein, 943 aa, Homo sapiens
MRPSGTAGAALLALLAALCPASRALEEKKGNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 231 - protein, 314 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 232 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 233 - protein, 922 aa, Homo sapiens
MQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 234 - protein, 1255 aa, Homo sapiens [sequence omitted]

SEQ ID NO: 235 - protein, 1225 aa, Homo sapiens; identical to SEQ ID NO: 22

SEQ ID NO: 236 - protein, 1240 aa, Homo sapiens; identical to SEQ ID NO: 23

SEQ ID NO: 237 - protein, 1055 aa, Homo sapiens; identical to SEQ ID NO: 24

SEQ ID NO: 238 - protein, 603 aa, Homo sapiens; identical to SEQ ID NO: 25

SEQ ID NO: 239 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 240 - protein, 1292 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 241 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 242 - protein, 735 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 243 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 244 - protein, 719 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 245 - protein, 735 aa, Homo sapiens
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 246 - protein, 704 aa, Homo sapiens
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 247 - protein, 442 aa, Homo sapiens
MGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 248 - protein, 662 aa, Homo sapiens
MKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 249 - protein, 271 aa, Homo sapiens
MFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQISPEEEERRRVRRERNKLAAAKCRNRRKELTDFLQAETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 250 - protein, 235 aa, Homo sapiens
MFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 251 - protein, 135 aa, Homo sapiens
MFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQPGGRGAPPSKARAEQAGCGQVQEPEEGTDRLPAGGD

SEQ ID NO: 252 - protein, 205 aa, Homo sapiens
MFRDFGEPGPSSGNGGGYGGPAQPPAAAQAAQQISPEEEERRRVRRERNKLAAAKCRNRRKELTDFLQAETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 253 - protein, 169 aa, Homo sapiens
MFRDFGEPGPSSGNGGGYGGPAQPPAAAQAAQQETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 254 - protein, 117 aa, Homo sapiens
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEGQSQC

SEQ ID NO: 255 - protein, 117 aa, Homo sapiens
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 256 - protein, 135 aa, Homo sapiens
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 257 - protein, 250 aa, Homo sapiens [sequence omitted]

SEQ ID NO: 258 - protein, 264 aa, Homo sapiens
MHSKTPCGCFKPWKMADNFSLHDALSGSGNPNPQGWPGAWGNQPAGAGGYPGASYPGAYPGQAPPGAYPGQAPPGAYPGAPGAYPGAPAPGVYPGPPSGPGAYPSSGQPSATGAYPATGPYGAPAGPLIVPYNLPLPGGVVPRMLITILGTVKPNANRIALDFQRGNDVAFHFNPRFNENNRRVIVCNTKLDNNWGREERQSVFPFESGKPFKIQVLVEPDHFKVAVNDAHLLQYNHRVKKLNEISKLGISGDIDLTSASYTMI

SEQ ID NO: 259 - protein, 323 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 260 - protein, 355 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 261 - protein, 246 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRCGSCVKLTASRWPWMVSTCLNTTIA

SEQ ID NO: 262 - protein, 668 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 263 - protein, 575 aa, Homo sapiens
MDLVLKRCLLHLAVIGALLAVGATKGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 264 - protein, 661 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 265 - protein, 626 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPVPGILLTGQEAGLGQVPLIVGILLVLMAVVLASLIYRRRLMKQDFSVPQLPHSSSHWLRLPRIFCSCPIGENSPLLSGQQV

SEQ ID NO: 266 - protein, 619 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 267 - protein, 1464 aa, Homo sapiens [sequence omitted]

SEQ ID NO: 268 - protein, 1281 aa, Homo sapiens
MGRVGYWTLLVLPALLVWRGPAPSAAAEKGPPALNIAVMLGHSHDVTERELRTLWGPEQAAGLPLDVNVVALLMNRTDPKSLITHVCDLMSGARIHGLVFGDDTDQEAVAQMLDFISSHTFVPILGIHGGASMIMADKDPTSTFFQFGASIQQQATVMLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSIVTLEEAPFVIVEDIDPLTETCVRNTVPCRKFVKINNSTNEGMNVKKCCKGFCIDILKKLSRTVKFTYDLYLVTNGKHGKKVNNVWNGMIGEVVYQRAVMAVGSLTINEERSEVVDFSVPFVETGISVMVSRSNGTVSPSAFLEPFSASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGMTNAWLLGDAPRTLTNTRCHPRR

SEQ ID NO: 269 - protein, 879 aa, Homo sapiens
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 270 - protein, 158 aa, Human papillomavirus
MHQKRTAMFQDPQERPRKLPQLCTELQTTIHDIILECVYCKQQLLRREVYDFAFRDLCIVYRDGNPYAVCDKCLKFYSKISEYRHYCYSLYGTTLEQQYNKPLCDLLIRCINCQKPLCPEEKQRHLDKKQRFHNIRGRWTGRCMSCCRSSRTRRETQL

SEQ ID NO: 271 - protein, 98 aa, Human papillomavirus
MHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 272 - protein, 189 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 273 - protein, 110 aa, Homo sapiens
MTCPWCWWGTSVTWLHALWNLGRLRTSPEATASPTSRPRPRPGRAAALALAPAPGPSGTPRDPCDPAAPRAGVEDAFYTLVREIRQHKLRKLNPPDESGPGCMSCKCVLS

SEQ ID NO: 274 - protein, 170 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGSRSGSSSSSGTLWDPPGPM

SEQ ID NO: 275 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 276 - protein, 976 aa, Homo sapiens [sequence omitted]

SEQ ID NO: 277 - protein, 972 aa, Homo sapiens
MRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFPKPEHQQWIYMNRTFTDKWEDYPKSENESNIRYVSELHLTRLKGTEGGTYTFLVSNSDVNAAIAFNVYVNTKPEILTYDRLVNGMLQCVAAGFPEPTIDWYFCPGTEQRCSASVLPVDVQTLNSSGPPFGKLVVQSSIDSSAFKHNGTVECKAYNDVGKTSAYFNFAFKEQIHPHTLFTPLLIGFVIVAGMMCIIVMILTYKYLQKPMYEVQWKVVEEINGNNYVYIDPTQLPYDHKWEFPRNRLSFGKTLGAGAFGKVVEATAYGLIKSDAAMTVAVKMLKPSAHLTEREALMSELKVLSYLGNHMNIVNLLGACTIGGPTLVITEYCCYGDLLNFLRRKRDSFICSKQEDHAEAALYKNLLHSKESSCSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADPLKRPTFKQIVQLIEKQISESTNHIYSNLANCSPNRQKPVVDHSVRINSVGSTASSSQPLLVHDDV

SEQ ID NO: 278 - protein, 261 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 279 - protein, 238 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSWVILITELTMPALPMVLHGSLVPWRGGV

SEQ ID NO: 280 - protein, 218 aa, Homo sapiens
MWVPVVFLTLSVTWIGAAPLILSRIVGGWECEKHSQPWQVLVASRGRAVCGGVLVHPQWVLTAAHCIRKPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 281 - protein, 509 aa, Homo sapiens
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 282 - protein, 458 aa, Homo sapiens
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTRYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 283 - protein, 433 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 284 - protein, 115 aa, Homo sapiens
MPMFIVNTNVPRASVPDGFLSELTQQLAQATGKPPQYIAVHVVPDQLMAFGGSSEPCALCSLHSIGKIGGAQNRSYSKLLCGLLAERLRISPDRVYINYYDMNAANVGWNNSTFA

SEQ ID NO: 285 - protein, 309 aa, Homo sapiens
MSLEQRSLHCKPEEALEAQQEALGLVCVQAATSSSSPLVLGTLEEVPTAGSTDPPQSPQGASAFPTTINFTRQRQPSEGSSSREEEGPSTSCILESLFRAVITKKVADLVGFLLLKYRAREPVTKAEMLESVIKNYKHCFPEIFGKASESLQLVFGIDVKEADPTGHSYVLVTCLGLSYDGLLGDNQIMPKTGFLIIVLVMIAMEGGHAPEEEIWEELSVMEVYDGREHSAYGEPRKLLTQDLVQEKYLEYRQVPDSDPARYEFLWGPRALAETSYVKVLEYVIKVSARVRFFFPSLREAALREEEEGV

SEQ ID NO: 286 - protein, 369 aa, Homo sapiens
MPRAPKRQRCMPEEDLQSQSETQGLEGAQAPLAVEEDASSSTSTSSSFPSSFPSSSSSSSSSCYPLIPSTPEEVSADDETPNPPQSAQIACSSPSVVASLPLDQSDEGSSSQKEESPSTLQVLPDSESLPRSEIDEKVTDLVQFLLFKYQMKEPITKAEILESVIRNYEDHFPLLFSEASECMLLVFGIDVKEVDPTGHSFVLVTSLGLTYDGMLSDVQSMPKTGILILILSIIFIEGYCTPEEVIWEALNMMGLYDGMEHLIYGEPRKLLTQDWVQENYLEYRQVPGSDPARYEFLWGPRAHAEIRKMSLLKFLAKVNGSDPRSFPLWYEEALKDEEERAQDRIATTDDTTAMASASSSATGSFSYPE

SEQ ID NO: 287 - protein, 314 aa, Homo sapiens
MPLEQRSQHCKPEEGLEAQGEALGLVGAQAPATEEQETASSSSTLVEVTLREVPAAESPSPPHSPQGASTLPTTINYTLWSQSDEGSSNEEQEGPSTFPDLETSFQVALSRKMAELVHFLLLKYRAREPFTKAEMLGSVIRNFQDFFPVIFSKASEYLQLVFGIEVVEVVRIGHLYILVTCLGLSYDGLLGDNQIVPKTGLLIIVLAIIAKEGDCAPEEKIWEELSVLEASDGREDSVFAHPRKLLTQDLVQENYLEYRQVPGSDPACYEFLWGPRALVETSYVKVLHHLLKISGGPHISYPPLHEWAFREGEE

SEQ ID NO: 288 - protein, 314 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLSYDGLLGDNQVMPKTGLLIIVLAIIAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 289 - protein, 314 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 290 - protein, 317 aa, Homo sapiens
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 291 - protein, 314 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAKLVHFLLLKYRAREPVTKAEMLGSVVGNWQYFFPVIFSKASDSLQLVFGIELMEVDPIGHVYIFATCLGLSYDGLLGDNQIMPKTGFLIIILAIIAKEGDCAPEEKIWEELSVLEVFEGREDSIFGDPKKLLTQYFVQENYLEYRQVPGSDPACYEFLWGPRALIETSYVKVLHHMVKISGGPRISYPLLHEWALREGEE

SEQ ID NO: 292 - protein, 315 aa, Homo sapiens
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMPKAALLIIVLGVILTKDNCAPEEVIWEALSVMGVYVGKEHMFYGEPRKLLTQDWVQENYLEYRQVPGSDPAHYEFLWGSKAHAETSYEKVINYLVMLNAREPICYPSLYEEVLGEEQEGV

SEQ ID NO: 293 - protein, 373 aa, Homo sapiens
MPPVPGVPFRNVDNDSPTSVELEDWVDAQHPTDEEEEEASSASSTLYLVFSPSSFSTSSSLILGGPEEEEVPSGVIPNLTESIPSSPPQGPPQGPSQSPLSSCCSSFSWSSFSEESSSQKGEDTGTCQGLPDSESSFTYTLDEKVAELVEFLLLKYEAEEPVTEAEMLMIVIKYKDYFPVILKRAREFMELLFGLALIEVGPDHFCVFANTVGLTDEGSDDEGMPENSLLIIILSVIFIKGNCASEEVIWEVLNAVGVYAGREHFVYGEPRELLTKVWVQGHYLEYREVPHSSPPYYEFLWGPRAHSESIKKKVLEFLAKLNNTVPSSFPSWYKDALKDVEERVQATIDTADDATVMASESLSVMSSNVSFSE

SEQ ID NO: 294 - protein, 834 aa, Homo sapiens
MAQKMDCGAGLLGFQNPDACRAVCHPLPQPPASTLPLSAFPTLCDPPYSQLRDPPAVLSCYCTPLGASPAPAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 295 - protein, 778 aa, Homo sapiens
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 296 - protein, 1374 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 297 - protein, 1118 aa, Homo sapiens
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 298 - protein, 1104 aa, Homo sapiens
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 299 - protein, 880 aa, Homo sapiens
MELTGLEVALVLILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQCETVSQISWGQNTQGHLSPALSSHRLVQACSIHNFCHLSSTMCIYMHILTPGESSKTWGRSSVVPKEEGEEEEKRAPKKKGRTWGPGTLGQKELASGDEGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 300 - protein, 837 aa, Homo sapiens
MSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQCETVSQISWGQNTQGHLSPALSSHRLVQACSIHNFCHLSSTMCIYMHILTPGESSKTWGRSSVVPKEEGEEEEKRAPKKKGRTWGPGTLGQKELASGDEGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 301 - protein, 360 aa, Homo sapiens [sequence omitted]

SEQ ID NO: 302 - protein, 118 aa, Homo sapiens
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 303 - protein, 738 aa, Homo sapiens
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDGKTLPSWGQALLSQDFELLCRDGSRADVTEWRQCHLARVPAHAVVVRADTDGGLIFRLLNEGQRLFSHEGSSFQMFSSEAYGQKDLLFKDSTSELVPIATQTYEAWLGHEYLHAMKGLLCDPNRLPPYLRWCVLSTPEIQKCGDMAVAFRRQRLKPEIQCVSAKSPQHCMERIQAEQVDAVTLSGEDIYTAGKTYGLVPAAGEHYAPEDSSNSYYVVAVVRRDSSHAFTLDELRGKRSCHAGFGSPAGWDVPVGALIQRGFIRPKDCDVLTAVSEFFNASCVPVNNPKNYPSSLCALCVGDEQGRNKCVGNSQERYYGYRGAFRCLVENAGDVAFVRHTTVFDNTNGHNSEPWAAELRSEDYELLCPNGARAEVSQFAACNLAQIPPHAVMVRPDTNIFTVYGLLDKAQDLFGDDHNKNGFKMFDSSNYHGQDLLFKDATVRAVPVGEKTTYRGWLGLDYVAALEGMSSQQCSGAAAPAPGAPLLPLLLPALAARLLPPAL

SEQ ID NO: 304 - protein, 302 aa, Homo sapiens
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDESPSRRQTWTRSEEEEGECPAHEEARRTMRSSAGQAWKWAPVHRPQDESDKGEFGKRAKSRDMLG

SEQ ID NO: 305 - protein, 298 aa, Homo sapiens
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGGVSPAEAQRAWWVLEPPGARDVEAQLRRLQEERTCKVCLDRAVSIVFVPCGHLVCAECAPGLQLCPICRAPVRSRVRTFLS

SEQ ID NO: 306 - protein, 280 aa, Homo sapiens
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGARDVEAQLRRLQEERTCKVCLDRAVSIVFVPCGHLVCAECAPGLQLCPICRAPVRSRVRTFLS

SEQ ID NO: 307 - protein, 467 aa, Homo sapiens [sequence omitted]

SEQ ID NO: 308 - protein, 444 aa, Homo sapiens
MQQIPQEKSINDYLEKFYQLPSNQYQSTRKNGTNVIVEKLKEMQRFFGLNVTGKPNEETLDMMKKPRCGVPDSGGFMLTPGNPKWERTNLTYRIRNYTPQLSEAEVERAIKDAFELWSVASPLIFTRISQGEADINIAFYQRDHGDNSPFDGPNGILAHAFQPGQGIGGDAHFDAEETWTNTSANYNLFLVAAHEFGHSLGLAHSSDPGALMYPNYAFRETSNYSLPQDDIDGIQAIYGLSSNPIQPTGPSTPKPCDPSLTFDAITTLRGEILFFKDRYFWRRHPQLQRVEMNFISLFWPSLPTGIQAAYEDFDRDLIFLFKGNQYWALSGYDILQGYPKDISNYGFPSSVQAIDAAVFYRSKTYFFVNDQFWRYDNQRQFMEPGYPKSISGAFPGIESKVDAVFQQEHFFHVFSGPRYYAFDLIAQRVTRVARGNKWLNCRYG

SEQ ID NO: 309 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 310 - protein, 630 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 311 - protein, 273 aa, Homo sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 312 - protein, 264 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 313 - protein, 255 aa, Homo sapiens
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 314 - protein, 203 aa, Homo sapiens
MTPGTQSPFFLLLLLTVLTVVTGSGHASSTPGGEKETSATQRSSVPSSTEKNAIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 315 - protein, 150 aa, Homo sapiens
MTPGTQSPFFLLLLLTVLTVVTGSGHASSTPGGEKETSATQRSSVPSSTEKNAFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 316 - protein, 159 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 317 - protein, 158 aa, Homo sapiens
MTPGTQSPFFLLLLLTVLTVVTGSGHASSTPGGEKETSATQRSSVPSSTEKNAIPAPTTTKSCRETFLKCFCRFINKGVFWASPILSSVWGWGARLGHRAAGAGLCSGCAGHCLSHCLGCLSVPPKELRAAGHLSSPGYLPSYERVPHLPHPWALCAP

SEQ ID NO: 318 - protein, 475 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 319 - protein, 484 aa, Homo sapiens
MTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 320 - protein, 282 aa, Homo sapiens
MTPGTQSPFFLLLLLTVLTATTAPKPATVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 321 - protein, 219 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVWGWGARLGHRAAGAGLCSGCAGHCLSHCLGCLSVPPKELRAAGHLSSPGYLPSYERVPHLPHPWALCAP

SEQ ID NO: 322 - protein, 238 aa, Homo sapiens
MTPGTQSPFFLLLLLTVLTATTAPKPATVVTGSGHASSTPGGEKETSATQRSSVPSSTEKNAIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 323 - protein, 217 aa, Homo sapiens
MTPGTQSPFFLLLLLTVLTGGEKETSATQRSSVPSSTEKNAIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 324 - protein, 241 aa, Homo sapiens
MTPGTQSPFFLLLLLTVLTATTAPKPATVVTGSGHASSTPGGEKETSATQRSSVPSSTEKNAFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 325 - protein, 239 aa, Homo sapiens
MTPGTQSPFFLLLLLTVLTATTAPKPATVVTGSGHASSTPGGEKETSATQRSSVPSSTEKNAIPAPTTTKSCRETFLKWPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 326 - protein, 198 aa, Homo sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSGCLSVPPKELRAAGHLSSPGYLPSYERVPHLPHPWALCAP

SEQ ID NO: 327 - protein, 230 aa, Homo sapiens
MTPGTQSPFFLLLLLTVLTVVTGSGHASSTPGGEKETSATQRSSVPSSTEKNAIPAPTTTKSCRETFLKWPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 328 - protein, 189 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 329 - protein, 212 aa, Homo sapiens
MTPGTQSPFFLLLLLTVLTATTAPKPATVVTGSGHASSTPGGEKETSATQRSSVPSSTEKNAIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 330 - protein, 177 aa, Homo sapiens
MTPGTQSPFFLLLLLTVLTATTAPKPATVVTGSGHASSTPGGEKETSATQRSSVPSSTEKNALSTGVSFFFLSFHISNLQFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 331 - protein, 464 aa, Homo sapiens
MPSCSTSTMPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 332 - protein, 253 aa, Homo sapiens
MRGAPGNCVGAEQALARRKRAQTVAIRGHPRPPGPPGDTRAESPPDPLQSAGDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 333 - protein, 112 aa, Homo sapiens
MRGAPGNCVGAEQALARRKRAQTVAIRGHPRPPGPPGDTRAESPPDPLQSAGVLEVGAGPRLPRPPREGSTPGIKTNGAERSPQSPAGRRADAELLHVHHAGHDLQEPRPRV

SEQ ID NO: 334 - protein, 180 aa, Homo sapiens; identical to SEQ ID NO: 63

SEQ ID NO: 335 - protein, 677 aa, Homo sapiens
MDDPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQGRTCGPEHSKGGGRVDEGPQPRSVEPQDAGPLERSQGDEAGGHGEDRPEPLSPKESKKRKLELSRREQPPTEPGPQSASEVEKIALNLEGCALSQGSLRTGTQEVGGQDPGEAVQPCRQPLGARVADKVRKRRKVDEGAGDSAAVASGGAQTLALAGSPAPSGHPKAGHSENGVEEDTEGRTGPKEGTPGSPSETPGPSPAGPAGDEPAESPSETPGPRPAGPAGDEPAESPSETPGPRPAGPAGDEPAESPSETPGPSPAGPTRDEPAESPSETPGPRPAGPAGDEPAESPSETPGPRPAGPAGDEPAESPSETPGPSPAGPTRDEPAKAGEAAELQDAEVESSAKSGKP

SEQ ID NO: 336 - protein, 102 aa, Homo sapiens
MSARVRSRSRGRGDGQEAPDVVAFVAPGESQQEEPPTDNQDIEPGQEREGTPPIEERKVEGDCQEMDLEKTRSERGDGSDVKEKTPPNPKHAKTKEAGDGQP

SEQ ID NO: 337 - protein, 215 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKRWRLGRRTCWVTWRASAS

SEQ ID NO: 338 - protein, 483 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 339 - protein, 206 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKALVSGVSSH

SEQ ID NO: 340 - protein, 479 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSKPWTF

SEQ ID NO: 341 - protein, 484 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 342 - protein, 505 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIAWFQILLNTFDKSSGEEEDLEQ

SEQ ID NO: 343 - protein, 407 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVPFIISSQISLGFKSF

SEQ ID NO: 344 - protein, 403 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVPFIISSQISRK

SEQ ID NO: 345 - protein, 391 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 346 - protein, 357 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSEFSGSPYSHPQYSSYNDSWRFPNPGLLGSPYYYSAAARGAAPPAAATAYDRH

SEQ ID NO: 347 - protein, 362 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSPYYYSAAARGAAPPAAATAYDRH

SEQ ID NO: 348 - protein, 324 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQGVSFPGVPTATLSIPRTTTPGGSPTRGCLAPPTIIALPPEEPPHLQPPLPMTVTDPWSQAGTKH

SEQ ID NO: 349 - protein, 295 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQAPPTIIALPPEEPPHLQPPLPMTVTDPWSQAGTKH

SEQ ID NO: 350 - protein, 220 aa, Homo sapiens
MFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSPYYYSAAARGAAPPAAATAYDRH

SEQ ID NO: 351 - protein, 328 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSPYYYSAAARGAAPPAAATAYDRH

SEQ ID NO: 352 - protein, 319 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSPYYYSAAARGAAPPAAATAYDRH

SEQ ID NO: 353 - protein, 348 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 354 - protein, 291 aa, Homo sapiens
MDLEKNYPTPRTSRTGHGGVNQLGGVFVNGRPLPDVVRQRIVELAHQGVRPCDISRQLRVSHGCVSKILGRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSEFSGSPYSHPQYSSYNDSWRFPNPGLLGSPYYYSAAARGAAPPAAATAYDRH

SEQ ID NO: 355 - protein, 283 aa, Homo sapiens
MFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 356 - protein, 1106 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 357 - protein, 1042 aa, Homo sapiens
MSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 358 - protein, 945 aa, Homo sapiens
MITNVAFLVSLRTEATSAKPPLGTGRWILMPTMSTDSRVSPLSGLMLSRVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 359 - protein, 212 aa, Homo sapiens
MKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATAQKDEKCYEVFSLSQSSQRPNCDCPPCVFSEEEHTQVPCHQAGAQEAQPLQPSHFLDISEDWSLHTDDMIGSM

SEQ ID NO: 360 - protein, 509 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 361 - protein, 493 aa, Homo sapiens
MSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 362 - protein, 1606 aa, Homo sapiens
MSEDSRGDSRAESAKDLEKQLRLRVCVLSELQKTERDYVGTLEFLVSAFLHRMNQCAASKVDKNVTEETVKMLFSNIEDILAVHKEFLKVVEECLHPEPNAQQEVGTCFLHFKDKFRIYDEYCSNHEKAQKLLLELNKIRTIRTFLLNCMLLGGRKNTDVPLEGYLVTPIQRICKYPLILKELLKRTPRKHSDYAAVMEALQAMKAVCSNINEAKRQMEKLEVLEEWQSHIEGWEGSNITDTCTEMLMCGVLLKISSGNIQERVFFLFDNLLVYCKRKHRRLKNSKASTDGHRYLFRGRINTEVMEVENVDDGTADFHSSGHIVVNGWKIHNTAKNKWFVCMAKTPEEKHEWFEAILKERERRKGLKLGMEQDTWVMISEQGEKLYKMMCRQGNLIKDRKRKLTTFPKCFLGSEFVSWLLEIGEIHRPEEGVHLGQALLENGIIHHVTDKHQFKPEQMLYRFRYDDGTFYPRNEMQDVISKGVRLYCRLHSLFTPVIRDKDYHLRTYKSVVMANKLIDWLIAQGDCRTREEAMIFGVGLCDNGFMHHVLEKSEFKDEPLLFRFFSDEEMEGSNMKHRLMKHDLKVVENVIAKSLLIKSNEGSYGFGLEDKNKVPIIKLVEKGSNAEMAGMEVGKKIFAINGDLVFMRPFNEVDCFLKSCLNSRKPLRVLVSTKPRETVKIPDSADGLGFQIRGFGPSVVHAVGRGTVAAAAGLHPGQCIIKVNGINVSKETHASVIAHVTACRKYRRPTKQDSIQWVYNSIESAQEDLQKSHSKPPGDEAGDAFDCKVEEVIDKFNTMAIIDGKKEHVSLTVDNVHLEYGVVYEYDSTAGIKCNVVEKMIEPKGFFSLTAKILEALAKSDEHFVQNCTSLNSLNEVIPTDLQSKFSALCSERIEHLCQRISSYKKFSRVLKNRAWPTFKQAKSKISPLHSSDFCPTNCHVNVMEVSYPKTSTSLGSAFGVQLDSRKHNSHDKENKSSEQGKLSPMVYIQHTITTMAAPSGLSLGQQDGHGLRYLLKEEDLETQDIYQKLLGKLQTALKEVEMCVCQIDDLLSSITYSPKLERKTSEGIIPTDSDNEKGERNSKRVCFNVAGDEQEDSGHDTISNRDSYSDCNSNRNSIASFTSICSSQCSSYFHSDEMDSGDELPLSVRISHDKQDKIHSCLEHLFSQVDSITNLLKGQAVVRAFDQTKYLTPGRGLQEFQQEMEPKLSCPKRLRLHIKQDPWNLPSSVRTLAQNIRKFVEEVKCRLLLALLEYSDSETQLRRDMVFCQTLVATVCAFSEQLMAALNQMFDNSKENEMETWEASRRWLDQIANAGVLFHFQSLLSPNLTDEQAMLEDTLVALFDLEKVSFYFKPSEEEPLVANVPLTYQAEGSRQALKVYFYIDSYHFEQLPQRLKNGGGFKIHPVLFAQALESMEGYYYRDNVSVEEFQAQINAASLEKVKQYNQKLRAFYLDKSNSPPNSTSKAAYVDKLMRPLNALDELYRLVASFIRSKRTAACANTACSASGVGLLSVSSELCNRLGACHIIMCSSGVHRCTLSVTLEQAIILARSHGLPPRYIMQATDVMRKQGARVQNTAKNLGVRDRTPQSAPRLYKLCEPPPPAGEE

SEQ ID NO: 363 - protein, 979 aa, Homo sapiens
MSEDSRGDSRAESAKDLEKQLRLRVCVLSELQKTERDYVGTLEFLVSAFLHRMNQCAASKVDKNVTEETVKMLFSNIEDILAVHKEFLKVVEECLHPEPNAQQEVGTCFLHFKDKFRIYDEYCSNHEKAQKLLLELNKIRTIRTFLLNCMLLGGRKNTDVPLEGYLVTPIQRICKYPLILKELLKRTPRKHSDYAAVMEALQAMKAVCSNINEAKRQMEKLEVLEEWQSHIEGWEGSNITDTCTEMLMCGVLLKISSGNIQERVFFLFDNLLVYCKRKHRRLKNSKASTDGHRYLFRGRINTEVMEVENVDDGTADFHSSGHIVVNGWKIHNTAKNKWFVCMAKTPEEKHEWFEAILKERERRKGLKLGMEQDTWVMISEQGEKLYKMMCRQGNLIKDRKRKLTTFPKCFLGSEFVSWLLEIGEIHRPEEGVHLGQALLENGIIHHVTDKHQFKPEQMLYRFRYDDGTFYPRNEMQDVISKGVRLYCRLHSLFTPVIRDKDYHLRTYKSVVMANKLIDWLIAQGDCRTREEAMIFGVGLCDNGFMHHVLEKSEFKDEPLLFRFFSDEEMEGSNMKHRLMKHDLKVVENVIAKSLLIKSNEGSYGFGLEDKNKVPIIKLVEKGSNAEMAGMEVGKKIFAINGDLVFMRPFNEVDCFLKSCLNSRKPLRVLVSTKPRETVKIPDSADGLGFQIRGFGPSVVHAVGRGTVAAAAGLHPGQCIIKVNGINVSKETHASVIAHVTACRKYRRPTKQDSIQWVYNSIESAQEDLQKSHSKPPGDEAGDAFDCKVEEVIDKFNTMAIIDGKKEHVSLTVDNVHLEYGVVYEYDSTAGIKCNVVEKMIEPKGFFSLTAKILEALAKSDEHFVQNCTSLNSLNEVIPTDLQSKFSALCSERIEHLCQRISSYKKVQASERFYNFTARHAVWEHSFDLHSVSSTFPVPVTMEFLLLPPPLLGISQDGRQHCIPEDLPSQEMLLAERAPV

SEQ ID NO: 364 - protein, 102 aa, Homo sapiens
MVRYRVRSLSERSHEVYRQQLHGQEQGHHGQEEQGLSPEHVEVYERTHGQSHYRRRHCSRRRLHRIHRRQHRSCRRRKRRSCRHRRRHRRGCRTRKRTCRRH

SEQ ID NO: 365 - protein, 140 aa, Homo sapiens
MVRYRVRSLSERSHEVYRQQLHGQEQGHHGQEEQGLSPEHVEVYERTHGQSHYRRRHCSRRRLHRIHRRQHRSCRRRKRRSCRHRRRHRRESLGDPLNQNFLSQKAAEPGREHAEGTKLPGPLTPSWKLRKSRPKHQVRP

SEQ ID NO: 366 - protein, 77 aa, Homo sapiens
MVRYRVRSLSERSHEVYRQQLHGQEQGHHGQEEQGLSPEHVEVYERTHGQSHYRRRHCSRRRLHRIHRRQHRSCRRH

SEQ ID NO: 367 - protein, 123 aa, Homo sapiens
MVRYRVRSLSERSHEVYRQQLHGQEQGHHGQEEQGLSPEHVEVYERTHGQSHYRRRHCSRRRLHRIHRRQHRSCRRRKRRSCRHRRRHRREPGREHAEGTKLPGPLTPSWKLRKSRPKHQVRP

SEQ ID NO: 368 - protein, 102 aa, Homo sapiens
MVRYRVRSLSERSHEVYRQQLHGQEQGHHGQEEQGLSPEHVEVYERTHGQSHYRRRHCSRRRLHRIHRRQHRSCRRRKRRSCRHRRRHRRGLPAPPPCPACP

SEQ ID NO: 369 - protein, 593 aa, Homo sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 370 - protein, 256 aa, Homo sapiens
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 371 - protein, 114 aa, Homo sapiens
MAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 372 - protein, 211 aa, Homo sapiens
MQAIKCVVVGDGAVGKTCLLISYTTNAFPGEYIPTVFDNYSANVMVDGKPVNLGLWDTAGQEDYDRLRPLSYPQTVGETYGKDITSRGKDKPIADVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 373 - protein, 175 aa, Homo sapiens
MLPPMALPSVSWMLLSCLMLLSQVQGEEPQRELPSARIRCPKGSKAYGSHCYALFLSPKSWTDADLACQKRPSGNLVSVLSGAEGSFVSSLVKSIGNSYSYVWIGLHDPTQGTEPNGEGWEWSSSDVMNYFAWERNPSTISSPGHCASLSRSTAFLRWKDYNCNVRLPYVCKFTD

SEQ ID NO: 374 - protein, 181 aa, Homo sapiens
MCKGLAALPHSCLERAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVNIDHFTKDITMKNLVEPSLSSFDMAQKRIHALMEKDSLPRFVRSEFYQELIK

SEQ ID NO: 375 - protein, 73 aa, Homo sapiens
MAEKAKQIYEEFIQTEAPKEVNIDHFTKDITMKNLVEPSLSSFDMAQKRIHALMEKDSLPRFVRSEFYQELIK

SEQ ID NO: 376 - protein, 185 aa, Homo sapiens
MCKGLAALPHSCLERAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVGLWVNIDHFTKDITMKNLVEPSLSSFDMAQKRIHALMEKDSLPRFVRSEFYQELIK

SEQ ID NO: 377 - protein, 193 aa, Homo sapiens
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 378 - protein, 904 aa, Homo sapiens
MQASPLQTSQPTPPEELHAAAYVFTNDGQQMRSDEVNLVATGHQSKKKHSRKSKRHSSSKRRKSMSSWLDKQEDAAVTHSICEERINNGQPVADNVLSTAPPWPDATIAHNIREERMENGQSRTDKVLSTAPPQLVHMAAAGIPSMSTRDLHSTVTHNIREERMENGQPQPDNVLSTGPTGLINMAATPIPAMSARDLYATVTHNVCEQKMENVQPAPDNVLLTLRPRRINMTDTGISPMSTRDPYATITYNVPEEKMEKGQPQPDNILSTASTGLINVAGAGTPAISTNGLYSTVPHNVCEEKMENDQPQPNNVLSTVQPVIIYLTATGIPGMNTRDQYATITHNVCEERVVNNQPLPSNALSTVLPGLAYLATADMPAMSTRDQHATIIHNLREEKKDNSQPTPDNVLSAVTPELINLAGAGIPPMSTRDQYATVNHHVHEARMENGQRKQDNVLSNVLSGLINMAGASIPAMSSRDLYATITHSVREEKMESGKPQTDKVISNDAPQLGHMAAGGIPSMSTKDLYATVTQNVHEERMENNQPQPSYDLSTVLPGLTYLTVAGIPAMSTRDQYATVTHNVHEEKIKNGQAASDNVFSTVPPAFINMAATGVSSMSTRDQYAAVTHNIREEKINNSQPAPGNILSTAPPWLRHMAAAGISSTITRDLYVTATHSVHEEKMTNGQQAPDNSLSTVPPGCINLSGAGISCRSTRDLYATVIHDIQEEEMENDQTPPDGFLSNSDSPELINMTGHCMPPNALDSFSHDFTSLSKDELLYKPDSNEFAVGTKNYSVSAGDPPVTVMSLVETVPNTPQISPAMAKKINDDIKYQLMKEVRRFGQNYERIFILLEEVQGSMKVKRQFVEFTIKEAARFKKVVLIQQLEKALKEIDSHCHLRKVKHMRKR

SEQ ID NO: 379 - protein, 963 aa, Homo sapiens
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 380 - protein, 132 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 381 - protein, 466 aa, Homo sapiens
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 382 - protein, 151 aa, Homo sapiens
MSIPFSNTHYRIPQGFGNLLEGLTREILREQPDNIPAFAAAYFESLLEKREKTNFDPAEWGSKVEDRFYNNHAFEEQEPPEKSDPKQEESQISGKEEETSVTILDSSEEDKEKEEVAAVKIQAAFRGHIAREEAKKMKTNSLQNEEKEENK

SEQ ID NO: 383 - protein, 223 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGRFSLSTSMGAVHGTPKTITHNRDPKGGNMPGPTDCVRENSW

SEQ ID NO: 384 - protein, 188 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 385 - protein, 214 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGPKRGEHAWTHRLRERKQLVIYEEISDPEEDDE

SEQ ID NO: 386 - protein, 418 aa, Homo sapiens
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 387 - protein, 395 aa, Homo sapiens
MASVPMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 388 - protein, 290 aa, Homo sapiens
MALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 389 - protein, 390 aa, Homo sapiens
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 390 - protein, 177 aa, Homo sapiens
MTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 391 - protein, 356 aa, Homo sapiens
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 392 - protein, 213 aa, Homo sapiens
MTGSFYTHSPLTIQLTLSSHRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 393 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAEKVRRAIEQLAAMD

SEQ ID NO: 394 - protein, 137 aa, Homo sapiens
MGAPTLPPAWQPFLKDHRISTFKNWPFLEGCACTPERMAEAGFIHCPTENEPDLAQCFFCFKELEGWEPDDDPMQRKPTIRRKNLRKLRRKCAVPSSSWLPWIEASGRSCLVPEWLHHFQGLFPGATSLPVGPLAMS

SEQ ID NO: 395 - protein, 165 aa, Homo sapiens
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAEKVRRAIEQLAAMD

SEQ ID NO: 396 - protein, 546 aa, Homo sapiens
MLQDKGLSESEEAFRAPGPALGEASAANAPEPALAAPGLSGAALGSPPGPGADVVAAAAAEQTIENIKVGLHEKELWKKFHEAGTEMIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPETSFISVTSYQNHKITQLKIENNPFAKGFRGSDDSDLRVARLQSKEYPVISKSIMRQRLISPQLSATPDVGPLLGTHQALQHYQHENGAHSQLAEPQDLPLSTFPTQRDSSLFYHCLKRRADGTRHLDLPCKRSYLEAPSSVGEDHYFRSPPPYDQQMLSPSYCSEVTPREACMYSGSGPEIAGVSGVDDLPPPPLSCNMWTSVSPYTSYSVQTMETVPYQPFPTHFTATTMMPRLPTLSAQSSQPPGNAHFSVYNQLSQSQVRERGPSASFPRERGLPQGCERKPPSPHLNAANEFLYSQTFSLSRESSLQYHSGMGTVENWTDG

SEQ ID NO: 397 - protein, 545 aa, Homo sapiens
MLQDKGLSESEEAFRAPGPALGEASAANAPEPALAAPGLSGAALGSPPGPGADVVAAAAAEQTIENIKVGLHEKELWKKFHEAGTEMIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPETSFISVTSYQNHKITQLKIENNPFAKGFRGSDDSDLRVARLQSKEYPVISKSIMRQRLISPQLSATPDVGPLLGTHQALQHYQHENGAHSQLAEPQDLPLSTFPTQRDSSLFYHCLKRRDGTRHLDLPCKRSYLEAPSSVGEDHYFRSPPPYDQQMLSPSYCSEVTPREACMYSGSGPEIAGVSGVDDLPPPPLSCNMWTSVSPYTSYSVQTMETVPYQPFPTHFTATTMMPRLPTLSAQSSQPPGNAHFSVYNQLSQSQVRERGPSASFPRERGLPQGCERKPPSPHLNAANEFLYSQTFSLSRESSLQYHSGMGTVENWTDG

SEQ ID NO: 398 - protein, 1124 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 399 - protein, 1081 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 400 - protein, 976 aa, Homo sapiens
MDSLASLVLCGVSLLLSASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 401 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 402 - protein, 1069 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 403 - protein, 393 aa, Homo sapiens [sequence omitted]

SEQ ID NO: 404 - protein, 341 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 405 - protein, 346 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 406 - protein, 261 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 407 - protein, 209 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 408 - protein, 214 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 409 - protein, 354 aa, Homo sapiens
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 410 - protein, 307 aa, Homo sapiens
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 411 - protein, 302 aa, Homo sapiens
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 412 - protein, 234 aa, Homo sapiens
MAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 413 - protein, 182 aa, Homo sapiens
MAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 414 - protein, 187 aa, Homo sapiens
MAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 415 - protein, 519 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 416 - protein, 552 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVISNRLLYNATTNILEHVRKEKATKELPSLHVLVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 417 - protein, 208 aa, Homo sapiens
MGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 418 - protein, 456 aa, Homo sapiens
MLLGIQRQMKCRLRSDVTKRLEEDEHVNTHSPMRRGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 419 - protein, 3859 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQGKPTWSGMHSSSIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 420 - protein, 3830 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 421 - protein, 529 aa, Homo sapiens [sequence omitted]

SEQ ID NO: 422 - protein, 412 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 423 - protein, 395 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 424 - protein, 389 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 425 - protein, 371 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 426 - protein, 354 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 427 - protein, 327 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 428 - protein, 371 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 429 - protein, 317 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 430 - protein, 232 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 431 - protein, 215 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 432 - protein, 209 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 433 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 434 - protein, 174 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 435 - protein, 147 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 436 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 437 - protein, 137 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 438 - protein, 171 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVCDKPRR

SEQ ID NO: 439 - protein, 351 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVCDKPRR

SEQ ID NO: 440 - protein, 163 aa, Homo sapiens
MAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 441 - protein, 213 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRRSAGQEEGASLRVSGTRSLTRKD

SEQ ID NO: 442 - protein, 610 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGTQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 443 - protein, 556 aa, Homo sapiens
METAPKPGKDVPPKKDKLQTKRKKPREWKNPESQRGLSGTQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 444 - protein, 502 aa, Homo sapiens
MDFLLLQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGEKPFSCRWPSCQKKFARSDELVRHHNMHQRNMTKLQLAL

SEQ ID NO: 445 - protein, 519 aa, Homo sapiens
MDFLLLQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGEKPFSCRWPSCQKKFARSDELVRHHNMHQRNMTKLQLAL

SEQ ID NO: 446 - protein, 522 aa, Homo sapiens
MDFLLLQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 447 - protein, 302 aa, Homo sapiens
MEKGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGEKPFSCRWPSCQKKFARSDELVRHHNMHQRNMTKLQLAL

SEQ ID NO: 448 - protein, 288 aa, Homo sapiens
MEKGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 449 - protein, 81 aa, Homo sapiens
MESPKKKNQQLKVGILHLGSRQKKIRIQLRSQCATWKVICKSCISQTPGINLDLGSGVKVKIIPKEEHCKMPEAGEEQPQV

SEQ ID NO: 450 - protein, 69 aa, Homo sapiens
MESPKKKNQQLKVGILHLGSRQKKIRIQLRSQVLGREMRDMEGDLQELHQSNTGDKSGFGFRRQGEDNT

SEQ ID NO: 451 - protein, 497 aa, Homo sapiens
MTFNSFEGSKTCVPADINKEEEFVEEFNRLKTFANFPSGSPVSASTLARAGFLYTGEGDTVRCFSCHAAVDRWQYGDSAVGRHRKVSPNCRFINGFYLENSATQSTNSGIQNGQYKVENYLGSRDHFALDRPSETHADYLLRTGQVVDISDTIYPRNPAMYSEEARLKSFQNWPDYAHLTPRELASAGLYYTGIGDQVQCFCCGGKLKNWEPCDRAWSEHRRHFPNCFFVLGRNLNIRSESDAVSSDRNFPNSTNLPRNPSMADYEARIFTFGTWIYSVNKEQLARAGFYALGEGDKVKCFHCGGGLTDWKPSEDPWEQHAKWYPGCKYLLEQKGQEYINNIHLTHSLEECLVRTTEKTPSLTRRIDDTIFQNPMVQEAIRMGFSFKDIKKIMEEKIQISGSNYKSLEVLVADLVNAQKDSMQDESSQTSLQKEISTEEQLRRLQEEKLCKICMDRNIAIVFVPCGHLVTCKQCAEAVDKCPMCYTVITFKQKIFMS

SEQ ID NO: 452 - protein, 8 aa, Artificial Sequence
  Description of Artificial Sequence: Synthetic peptide
SIINFEKL

We claim:

1. A method of selecting tumor antigens, the method comprising:
   a) obtaining, providing, or generating a library comprising bacterial cells or beads comprising a plurality of tumor antigens, wherein each bacterial cell or bead of the library comprises a different tumor antigen;
   b) contacting the bacterial cells or beads with antigen presenting cells (APCs) from a subject, wherein the APCs internalize the bacterial cells or beads;
   c) contacting the APCs with lymphocytes from the subject, under conditions suitable for activation of lymphocytes by a tumor antigen presented by one or more APCs;
   d) determining whether one or more lymphocytes are activated by one or more tumor antigens presented by one or more APCs by assessing a level of expression and/or secretion of one or more immune mediators;
   e) identifying each activating tumor antigen as (i) an antigen that stimulates the level of expression and/or secretion of one or more immune mediators, or (ii) an antigen that inhibits and/or suppresses the level of expression and/or secretion of one or more immune mediators; and
   f) selecting from among the identified tumor antigens (i) one or more antigens that increase a level of expression and/or secretion of one or more immune mediators associated with at least one beneficial response to cancer, (ii) one or more tumor antigens that inhibit and/or suppress a level of expression and/or secretion of one or more immune mediators associated with at least one deleterious and/or non-beneficial response to cancer, (iii) one or more antigens that increase a level of expression and/or secretion of one or more immune mediators associated with at least one deleterious and/or non-beneficial response to cancer, and/or (iv) one or more tumor antigens that inhibit and/or suppress a level of expression and/or secretion of one or more immune mediators associated with at least one beneficial response to cancer.

2. The method of claim 1, further comprising administering to the subject an immunogenic composition comprising i) one or more antigens that increase a level of expression and/or secretion of one or more immune mediators associated with at least one beneficial response to cancer, and/or (ii) one or more tumor antigens that inhibit and/or suppress a level of expression and/or secretion of one or more immune mediators associated with at least one deleterious and/or non-beneficial response to cancer, or immunogenic fragments thereof.

3. A method of selecting tumor antigens, the method comprising:
   a) providing a library comprising bacterial cells or beads, wherein each bacterial cell or bead of the library comprises a different heterologous polypeptide comprising one or more mutations, splice variants, or translocations expressed in a cancer or tumor cell expressed in a cancer or tumor cell of a subject;
   b) contacting the bacterial cells or beads with antigen presenting cells (APCs) from the subject, wherein the APCs internalize the bacterial cells or beads;
   c) contacting the APCs with lymphocytes from the subject, under conditions suitable for activation of lymphocytes by a polypeptide presented by one or more APCs;
   d) determining whether one or more lymphocytes are activated by, or not responsive to, one or more polypeptides presented by one or more APCs, by assessing a level of expression and/or secretion of one or more immune mediators;
   e) identifying each activating tumor antigen as (i) an antigen that stimulates the level of expression and/or secretion of one or more immune mediators, or (ii) an antigen that inhibits and/or suppresses the level of expression and/or secretion of one or more immune mediators, wherein stimulation, inhibition and/or suppression indicate that the polypeptide is a tumor antigen; and
   f) selecting from among the identified tumor antigens (i) one or more tumor antigens that increase level of expression and/or secretion of one or more immune mediators associated with at least one beneficial response to cancer, (ii) one or more tumor antigens that inhibit and/or suppress level of expression and/or secretion of one or more immune mediators associated with at least one deleterious and/or non-beneficial response to cancer, (iii) one or more tumor antigens that increase level of expression and/or secretion of one or more immune mediators associated with at least one deleterious and/or non-beneficial response to cancer, and/or (iv) one or more tumor antigens that inhibit and/or suppress level of expression and/or secretion of one or more immune mediators associated with at least one beneficial response to cancer.

4. The method of claim 3, further comprising repeating steps b) through e), or steps c) through e), with lymphocytes from the subject that have undergone one or more previous rounds of exposure to APCs.

5. The method of claim 3, further comprising administering to the subject an immunogenic composition comprising i) one or more antigens that increase a level of expression and/or secretion of one or more immune mediators associated with at least one beneficial response to cancer, and/or (ii) one or more tumor antigens that inhibit and/or suppress a level of expression and/or secretion of one or more immune mediators associated with at least one deleterious and/or non-beneficial response to cancer, or immunogenic fragments thereof.

6. The method of claim 5, further comprising administering to the subject a cancer therapy or combination of therapies.

7. The method of claim 3, further comprising administering to the subject an immunogenic composition that does not comprise (iii) one or more tumor antigens that increase level of expression and/or secretion of one or more immune mediators associated with at least one deleterious and/or non-beneficial response to cancer, and/or (iv) one or more tumor antigens that inhibit and/or suppress level of expression and/or secretion of one or more immune mediators associated with at least one beneficial response to cancer, or immunogenic fragments thereof.

8. The method of claim 3, wherein the APCs are human APCs isolated from the subject.

9. The method of claim 3, wherein the bacterial cells further comprise a cytolysin polypeptide.

10. The method of claim 9, wherein the cytolysin polypeptide is listeriolysin O (LLO).

11. The method of claim 3, wherein the APCs are provided in an array, and wherein the APCs in each location of the array are contacted with a set of bacterial cells, each set comprising a different tumor antigen.

12. The method of claim 3, wherein the APCs and lymphocytes are isolated from peripheral blood.

13. The method of claim 3, wherein the lymphocytes are derived from a cancer or tumor.

14. The method of claim 3, wherein lymphocyte activation is determined by assessing a level of one or more expressed or secreted immune mediators that is at least about 20% higher or lower than a control level.

15. The method of claim 3, wherein lymphocyte activation is determined by assessing a level of one or more expressed or secreted immune mediators that is at least two standard deviations greater or lower than the mean of a control level.

16. The method of claim 3, wherein lymphocyte activation is determined by assessing a level of one or more expressed or secreted immune mediators that is at least 2 median absolute deviations (MADs) greater or lower than a median response level to a control.

17. The method of claim 3, wherein lymphocyte non-responsiveness is determined by assessing a level of one or more expressed or secreted immune mediators that is within about 20% of a control level.

18. The method of claim 3, wherein lymphocyte non-responsiveness is determined by assessing a level of one or more expressed or secreted immune mediators that is less than one standard deviation higher or lower than the mean of a control level.

19. The method of claim 3, wherein lymphocyte non-responsiveness is determined by assessing a level of one or more expressed or secreted immune mediators that is less than one median absolute deviation (MAD) higher or lower than a median response level to a control.

20. The method of claim 1, further comprising administering to the subject an immunogenic composition that does not comprise (iii) one or more tumor antigens that increase level of expression and/or secretion of one or more immune mediators associated with at least one deleterious and/or non-beneficial response to cancer, and/or (iv) one or more tumor antigens that inhibit and/or suppress level of expression and/or secretion of one or more immune mediators associated with at least one beneficial response to cancer, or immunogenic fragments thereof.

21. The method of claim 1, wherein lymphocyte activation is determined by assessing a level of one or more expressed or secreted immune mediators that is at least about 60% higher or lower than a control level.

22. The method of claim 1, wherein lymphocyte activation is determined by assessing a level of one or more expressed or secreted immune mediators that is at least two standard deviations greater or lower than the mean of a control level.

23. The method of claim 1, wherein lymphocyte activation is determined by assessing a level of one or more expressed or secreted immune mediators that is at least 2 median absolute deviations (MADs) greater or lower than a median response level to a control.

24. The method of claim 1, wherein lymphocyte non-responsiveness is determined by assessing a level of one or more expressed or secreted immune mediators that is within about 20% of a control level.

25. The method of claim 1, wherein lymphocyte non-responsiveness is determined by assessing a level of one or more expressed or secreted immune mediators that is less than one standard deviation higher or lower than the mean of a control level.

26. The method of claim 1, wherein lymphocyte non-responsiveness is determined by assessing a level of one or more expressed or secreted immune mediators that is less than one median absolute deviation (MAD) higher or lower than a median response level to a control.

* * * * *

UNITED STATES PATENT AND TRADEMARK OFFICE
CERTIFICATE OF CORRECTION

PATENT NO. : 10,859,566 B2
APPLICATION NO. : 15/927067
DATED : December 8, 2020
INVENTOR(S) : Jessica Baker Flechtner et al.

Page 1 of 1

It is certified that error appears in the above-identified patent and that said Letters Patent is hereby corrected as shown below:

In the Claims

Claim 3, Column 355, Line 58, delete "expressed in a cancer or tumor cell".

Claim 4, Column 356, Line 31, replace "have" with --has--.

Signed and Sealed this
Second Day of November, 2021

Drew Hirshfeld
*Performing the Functions and Duties of the*
*Under Secretary of Commerce for Intellectual Property and*
*Director of the United States Patent and Trademark Office*